United States Patent
Akinc et al.

(10) Patent No.: US 12,338,439 B2
(45) Date of Patent: Jun. 24, 2025

(54) FACTOR XII (HAGEMAN FACTOR) (F12), KALLIKREIN B, PLASMA (FLETCHER FACTOR) 1 (KLKB1), AND KININOGEN 1 (KNG1) iRNA COMPOSITIONS AND METHODS OF USE THEREOF

(71) Applicant: Alnylam Pharmaceuticals, Inc., Cambridge, MA (US)

(72) Inventors: Akin Akinc, Needham, MA (US); Gregory Hinkle, Plymouth, MA (US); Martin A. Maier, Belmont, MA (US); James Butler, Lynnfield, MA (US); Jingxuan Liu, West Roxbury, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 18/218,155

(22) Filed: Jul. 5, 2023

(65) Prior Publication Data
US 2024/0076664 A1  Mar. 7, 2024

Related U.S. Application Data

(60) Continuation of application No. 17/121,858, filed on Dec. 15, 2020, now abandoned, which is a
(Continued)

(51) Int. Cl.
*C12N 15/11* (2006.01)
*A61K 31/713* (2006.01)
(Continued)

(52) U.S. Cl.
CPC .......... *C12N 15/113* (2013.01); *A61K 31/713* (2013.01); *A61K 45/06* (2013.01);
(Continued)

(58) Field of Classification Search
CPC .............. C12N 15/113; C12N 15/1137; C12N 2310/321; C12N 2310/322; C12N 2310/3521; A61K 31/713; A61P 9/10
See application file for complete search history.

(56) References Cited

U.S. PATENT DOCUMENTS 9,574,013 B2 *  2/2017  Gruber .................. C07K 16/36
9,803,205 B2   10/2017  Kanner et al.
(Continued)

FOREIGN PATENT DOCUMENTS

CN    102600471 A    7/2012
EP      1752536 A1   2/2007
(Continued)

OTHER PUBLICATIONS

EMBL Database Accession No. FW736821; Sequence 143347 from PCT Publication No. WO 2005/116204.
(Continued)

*Primary Examiner* — Terra C Gibbs
(74) *Attorney, Agent, or Firm* — McCarter & English, LLP; Maria Laccotripe Zacharakis; Dylan M. Blumenthal

(57) ABSTRACT

The present invention relates to RNAi agents, e.g., double stranded RNAi agents, targeting the Kallikrein B, Plasma (Fletcher Factor) 1 (KLKB1) gene, the Factor XII (Hageman Factor (F12) gene, or the Kininogen 1 (KNG1) gene, and methods of using such RNAi agents to inhibit expression of a KLKB1 gene, an F12 gene, and/or a KNG1 gene, and methods of treating subjects having an hereditary angioedema (HAE) and/or a contact activation pathway-associated disorder.

16 Claims, 13 Drawing Sheets

Specification includes a Sequence Listing.

Related U.S. Application Data continuation of application No. 16/421,745, filed on May 24, 2019, now Pat. No. 10,934,544, which is a division of application No. 15/800,517, filed on Nov. 1, 2017, now abandoned, which is a continuation of application No. PCT/US2016/030876, filed on May 5, 2016.

(60) Provisional application No. 62/266,958, filed on Dec. 14, 2015, provisional application No. 62/260,887, filed on Nov. 30, 2015, provisional application No. 62/157,890, filed on May 6, 2015.

(51) Int. Cl.
| | |
|---|---|
| A61K 45/06 | (2006.01) |
| A61K 47/54 | (2017.01) |
| C07H 21/02 | (2006.01) |
| C12N 15/113 | (2010.01) |
| C12Q 1/6883 | (2018.01) |

(52) U.S. Cl.
CPC ........ *A61K 47/549* (2017.08); *C12N 15/1137* (2013.01); *C12Q 1/6883* (2013.01); *C12N 2310/14* (2013.01); *C12N 2310/31* (2013.01); *C12N 2310/321* (2013.01); *C12N 2310/322* (2013.01); *C12N 2310/344* (2013.01)

(56) References Cited

U.S. PATENT DOCUMENTS

| | | |
|---|---|---|
| 10,883,107 B2 | 1/2021 | Hinkle |
| 10,934,544 B2 | 3/2021 | Akinc et al. |
| 12,049,630 B2 | 7/2024 | Schmidt et al. |
| 2007/0083334 A1 | 4/2007 | Mintz et al. |
| 2008/0113351 A1 | 5/2008 | Naito et al. |
| 2011/0178283 A1 | 7/2011 | Rigoutsos et al. |
| 2014/0288158 A1 | 9/2014 | Rajeev et al. |
| 2015/0368642 A1 | 12/2015 | Alb et al. |
| 2016/0272970 A1 | 9/2016 | Rozema et al. |
| 2018/0100150 A1 | 4/2018 | Akinc et al. |
| 2019/0264210 A1 | 8/2019 | Kole et al. |
| 2020/0208150 A1 | 7/2020 | Butler et al. |
| 2021/0222176 A1 | 7/2021 | Hinkle |
| 2021/0246447 A1 | 8/2021 | Akinc et al. |
| 2022/0267767 A1 | 8/2022 | Butler et al. |
| 2024/0132896 A1 | 4/2024 | Schmidt et al. |
| 2024/0254482 A1 | 8/2024 | Butler et al. |

FOREIGN PATENT DOCUMENTS

| | | |
|---|---|---|
| WO | WO-2007059966 A1 | 5/2007 |
| WO | WO-2007130604 A2 | 11/2007 |
| WO | WO-2009053050 A1 | 4/2009 |
| WO | WO-2012064758 A2 | 5/2012 |
| WO | WO-2012170947 A2 | 12/2012 |
| WO | WO-2012177784 A2 | 12/2012 |
| WO | WO-2016149331 A2 | 9/2016 |
| WO | WO-2016179342 A2 | 11/2016 |
| WO | WO-2017120397 A1 | 7/2017 |
| WO | WO-2018098328 A1 | 5/2018 |
| WO | WO-2018140920 A1 | 8/2018 |
| WO | WO-2019010342 A1 | 1/2019 |
| WO | WO-2023019246 A1 | 2/2023 |

OTHER PUBLICATIONS

Cai et al., "Factor XII full and partial null in rat confers robust antithrombotic efficacy with no bleeding," Blood Coagulation & Fibrinolysis, 2015, 26:893-902.
International Search Report from PCT/US2016/030876 mailed on Nov. 28, 2016.
Papageorgiou et al. "Coagulation Factor XIIa-kinin-mediated contribution to hypertension of chronic kidney disease," Journal of Hypertension, 2014, 32(7):1523-1533.
International Search Report from PCT/US2017/012420 maled Mar. 1, 2017.
European Search Report from EP Application No. 17736380.1 dated Jun. 18, 2019.
Reynolds et al., Rational siRNA design for RNA interference. Nat Biotechnol. Mar. 2004;22(3):326-30.
Allerson et al., "Fully 2'-Modified Oligonucleotide Duplexes with Improved in Vitro Potency and Stability Compared to Unmodified Small Interfering RNA", J. Med. Chem.48(4):901-904, 2005.
Bhattacharjee et al., "Inhibition of Vascular Permeability by Antisense-Mediated Inhibition of Plasma Kallikrein and Coagulation Factor 12", Nucleic Acid Therapeutics, vol. 23, No. 3, Jun. 1, 2013, pp. 175-187.
Vickers et al., "Efficient Reduction of Target RNAs by Small Interfering RNA and RNase H-dependent Antisense Agents", JBC, vol. 278, No. 9, 7108-7118, 2003.
Kenne et al., "Factor XII: a drug target for safe interference with thrombosis and inflammation", Drug Discovery Today., US, (Sep. 1, 2014), vol. 19, No. 9, pp. 1459-1464.
Davidkova et al., "Pharmacological Inhibition of Dopaminergic and Other Neurotransmitter Receptors Using Antisense Oligodeoxynucleotides" in, Antisense Research and Applications, 1993, CRC Press. p. 263-308.
Zhu et al. "Proof-of-concept Studies for siRNA-mediated Gene Silencing for Coagulation Factors in Rat and Rabbit", Molecular Therapy—Nucleic Acids, vol. 4, No. 1, Jan. 27, 2015, p. e224, XP055285909; - & Chen Zhu et al: "Supplementary Material: Proof-of-concept Studies for si RNA-mediated Gene Silencing for Coagulation Factors in Rat and Rabbit", Molecular Therapy—Nucleic Acids, Jan. 27, 2015, XP55888224; - & Chen Zhu et al: "Supplementary Figure 3: Proof-of-concept Studies for siRNA-mediated Gene Silencing for Coagulation Factors in Rat and Rabbit", Molecular Therapy—Nucleic Acids,Jan. 27, 2015.
Zhang et al. "Coagulation Factor X Regulated by CASC2c Recruited Macrophages and Induced M2 Polarization in Glioblastoma Multiforme", Frontiers in Immunology, vol. 9, Jul. 6, 2018.
Ankrom et al. "Preclinical and translational evaluation of coagulation factor IXa as a novel therapeutic target", Pharmacology Research & Perspectives, vol. 4, No. 1, Jan. 15, 2016.
Hu et al. "Therapeutic siRNA: state of the art", Signal Transduction and Targeted Therapy, vol. 5, No. 1, Jun. 19, 2020.
International Search Report and Written Opinion from PCT/US2018/040967, mailed Oct. 2, 2018.
Björkqvist, et al., "In vivo activation and functions of the protease factor XII", Thromb Haemost 2014; 112: 868-875.

* cited by examiner

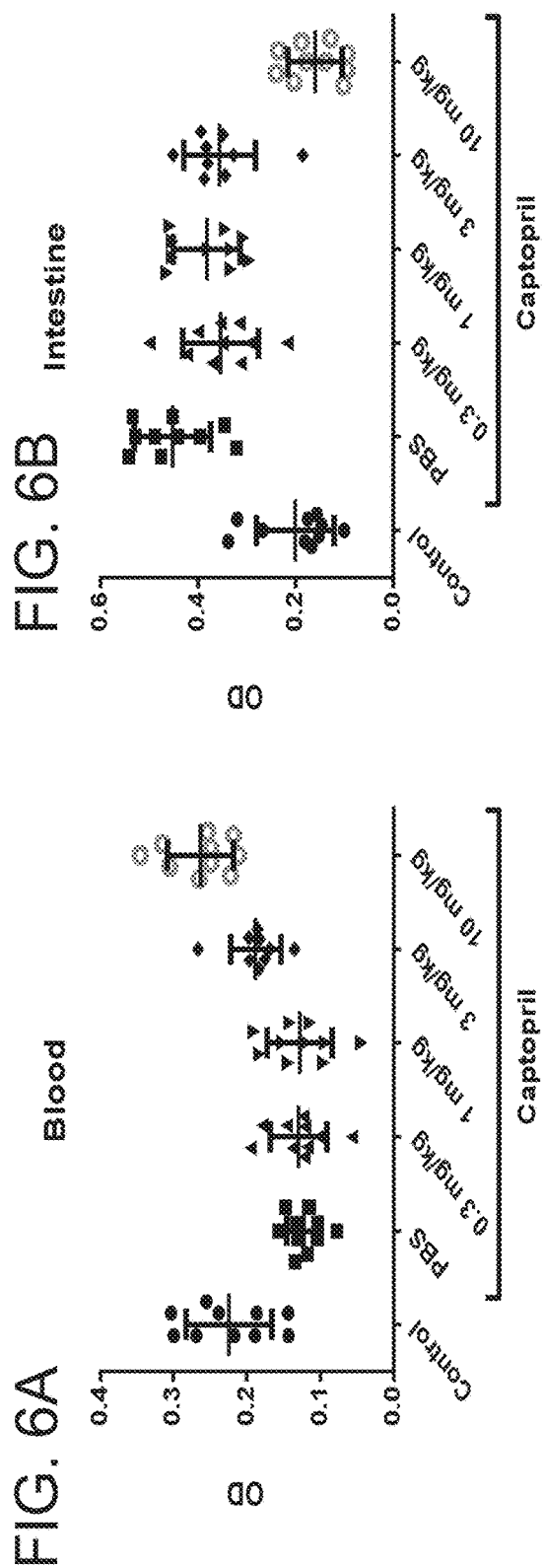
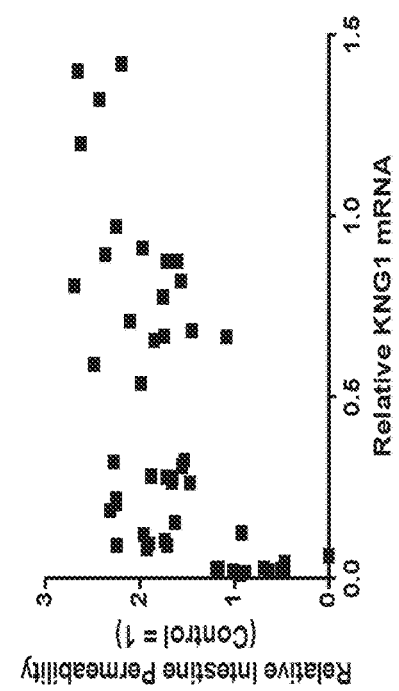
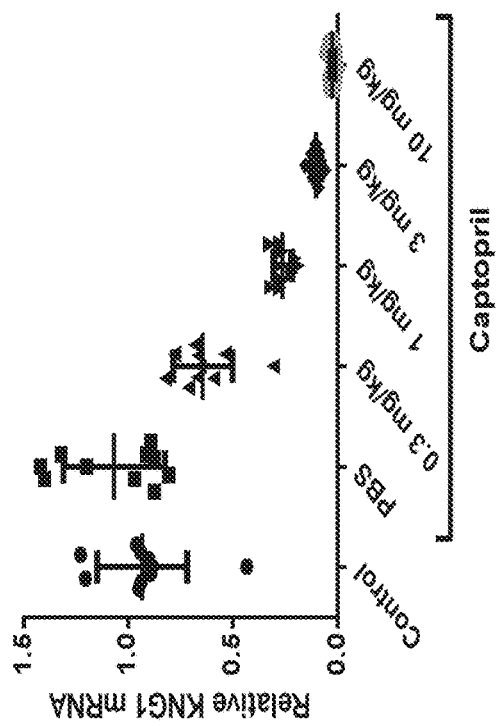
FIG. 6A  FIG. 6B  FIG. 6C  FIG. 6D

FACTOR XII (HAGEMAN FACTOR) (F12), KALLIKREIN B, PLASMA (FLETCHER FACTOR) 1 (KLKB1), AND KININOGEN 1 (KNG1) iRNA COMPOSITIONS AND METHODS OF USE THEREOF

RELATED APPLICATIONS

This application is a continuation of U.S. patent application Ser. No. 17/121,858, filed on Dec. 15, 2020, which is a continuation of U.S. patent application Ser. No. 16/421,745, filed on May 24, 2019, which is a divisional of U.S. patent application Ser. No. 15/800,517, filed on Nov. 1, 2017, abandoned, which is a 35 § U.S.C. 111(a) continuation application which claims the benefit of priority to PCT/US2016/030876, filed on May 5, 2016, which claims the benefit of priority to U.S. Provisional Application No. 62/157,890, filed on May 6, 2015, to U.S. Provisional Patent Application No. 62/260,887, filed on Nov. 30, 2015, and to U.S. Provisional Patent Application No. 62/266,958, filed on Dec. 14, 2015. The entire contents of each of the foregoing applications are hereby incorporated herein by reference.

SEQUENCE LISTING

The instant application contains a Sequence Listing which has been submitted electronically in XML format and is hereby incorporated by reference in its entirety. Said XML copy, created on Nov. 15, 2023, is named 121301_03107_SL.xml and is 14,911,131 bytes in size. The sequence listing is part of the specification and is incorporated in its entirety by reference herein.

BACKGROUND OF THE INVENTION

The blood coagulation system is essential for hemostasis, responding to vascular injury with local production of a clot formed of fibrin mesh and activated platelets. Blood coagulation, thrombin generation, and fibrin formation can be initiated by two distinct pathways, referred to as the extrinsic and intrinsic pathways.

The extrinsic pathway involves binding of plasma factor VIIa (FVIIa) to extravascular tissue factor (TF) at a site of vessel injury.

The intrinsic pathway is initiated by the surface-dependent activation of plasma factor XII (F12) to F12a in a process called contact activation. Contact activation involves two other proteins, prekallikrein and high molecular weight kininogen which circulate as a bi-molecular complex. Collectively, these three proteins, FXII, prekallikrein and HK, comprise the "contact activation pathway," also referred to as the "Kallikrein-Kinin System." When the contact activation pathway is initiated by binding of F12 to negatively charged surfaces (or macromolecules), a conformational change in F12 is induced resulting in formation of active F12 (F12a). F12a cleaves prekallikrein to generate active kallikrein (α-kallikrein), which in turn reciprocally activates F12 to generate additional F12a. The active kallikrein then digests high-molecular-weight kininogen to liberate bradykinin. F12a generated by contact activation also activates factor XI (F11) to F11a, triggering a series of proteolytic cleavage events that culminates in thrombin generation and fibrin clot formation.

Interestingly, it has been shown that the contact system is not required for hemostasis. Humans and other animals deficient in a contact activation protein are largely asymptomatic and homozygous F12 deficiency is not associated with any disease or disorder. However, the contact system has been shown to play an important role in thrombotic disease, as pharmacologic inhibition of F12a or ablation of the F12 or high molecular weight kininogen genes can protect mice from experimentally induced thrombosis in a variety of models.

In healthy subjects, a homeostatic balance between procoagulant forces and anticoagulant and fibrinolytic forces exists. However, numerous genetic, acquired, and environmental factors can dysregulate this balance in favor of coagulation, leading to thrombosis, the pathologic formation of thrombi, triggering life-threatening events For example, formation of thrombi in a vein may result in, e.g., deep venous thrombosis (DVT), and formation of thrombi in an artery or a cardiac chamber may result in, e.g., myocardial infarction or stroke. Thrombi may obstruct blood flow at the site of formation or detach and embolize to block a distant blood vessel (e.g., a pulmonary embolism or embolic stroke).

Acquired/enviornmental factors that can lead to pathological contact activation and contact pathway-mediated thrombosis include various dental, surgical and medical settings, such as atrial fibrillation, cancer treatment, immobilization, central venous catheters, implants, and extracorporeal oxygenation. As a result of such medical and surgical settings, tissue damage releases tissue factor and exposes various triggers of the contact pathway, such as DNA, RNA, phosphate, collagen, and laminin) which activate the contact pathway leading to thrombosis.

A genetic disorder that dysregulates the homeostatic balance between procoagulant forces and anticoagulant and fibrinolytic forces is Hereditary Angioedema (HAE). HAE is a rare autosomal dominant disorder that causes recurrent edema and swelling of the extremities, face, larynx, upper respiratory tract, abdomen, trunk, and genitals and a nonpruritic rash in one-third of patients. Untreated HAE patients experience an average of one-to-two angioedema attacks per month, but the frequency and severity of episodes can vary significantly. Edema swelling is often disfiguring and disabling, results in frequent hospitalization, and patients sometimes require psychiatric care to treat disease-associated anxiety. Abdominal attacks can cause severe pain, nausea and vomiting, and sometimes lead to inappropriate surgeries. Furthermore, over half of HAE patients also experience life-threatening laryngeal edema during their lifetime that may require emergency tracheostomy to prevent asphyxiation. HAE affects an estimated 6,000 to 10,000 individuals of varying ethnic groups in the United States and causes significant economic harm to patients, accounting for 15,000 to 30,000 hospital visits and 20 to 100 sick days per year.

HAE results from a mutation of the C1 inhibitor (C1INH, SERPING1) gene that results in a deficiency of C1INH protein. Over 250 different C1INH mutations have been demonstrated to cause an HAE clinical presentation. These C1INH mutations are typically inherited genetically, however, up to 25% of HAE cases result from de novo mutation of C1INH. HAE type I is caused by C1INH mutations that result in lower levels of truncated or misfolded proteins that are inefficiently secreted, and accounts for approximately 85% of HAE cases. HAE type II constitutes about 15% of cases and is caused by mutations near the C1INH's active site that result in normal levels of dysfunctional C1INH protein. In addition, HAE type III, a rare third form the disease, occurs because of a gain-of-function mutation in coagulation factor XII (F12) (Hageman Factor).

C1 inhibitor is a serine protease inhibitor of the serpin family and a major inhibitor of proteases in the complement and contact activation pathways, as well as a minor inhibitor of fibrinolytic protease plasmin. These plasma proteolytic cascades are activated during an HAE attack, generating substances that increase vascular permeability, e.g., bradykinin. Studies have shown that the bradykinin peptide, which activates proinflammatory signaling pathways that dilate vessels and induces chemotaxis of neutrophils, is the primary substance that enhances vascular permeability in an HAE attack by binding to the bradykinin receptor on vascular endothelial cells.

Typically, C1INH inhibits the autoactivation of F12 the ability of F12a to activate prekallirein, the activation of high molecular weight kininogen by kallikrein, and the feedback activation of F12 by kallikrein. Consequently, mutations causing C1INH deficiency or F12 gain-of-function result in excess production of bradykinin and onset of HAE angioedema.

Currently, HAE may be treated with 17α-alkylated androgens prophylactically to reduce to probability of recurrent episodes, or with disease-specific therapeutics to treat acute attacks. About 70% of individuals with HAE are treated with androgens or remain untreated, and about 30% receive therapeutics. Androgens are unsuitable for short-term treatment of acute attacks because they take several days to become effective, and they can have significant side effects and may affect growth and development adversely. As a result, androgens are used only for long-term prophylaxis and are typically not administered to pregnant women or children. Furthermore, current therapeutics used to treat acute attacks must be administered intravenously numerous times per week or may cause side-effects that require drug administration and subsequent patient monitoring in a hospital, thereby limiting their regular prophylactic use to manage the disease long-term. Therefore, in the absence of regimens which be administered safely, effectively and by more convenient routes and regimens to treat acute angioedema attacks and prophylactically manage recurrent attacks in a large proportion of patients, including pregnant women and children, there is a need for alternative therapies for subjects suffering from HAE.

Accordingly, there is a need in the art for compositions and methods to inhibit thrombosis in a subject at risk of forming a thrombus, such as a subject having a genetic, an acquired, or an environmental risk of forming a thrombus.

SUMMARY OF THE INVENTION

The present invention provides iRNA compositions which effect the RNA-induced silencing complex (RISC)-mediated cleavage of RNA transcripts of a Kallikrein B, Plasma (Fletcher Factor) 1 (KLKB1) gene, RNA transcripts of a Factor XII (F12) gene, or RNA transcripts of a kininogen (KNG1) gene. For simplicity, and unless otherwise specified, the term "contact activation pathway gene" as used herein refers to a KLKB1 gene, an F12 gene, or a KNG1 gene. The contact activation pathway gene may be within a cell, e.g., a cell within a subject, such as a human.

Accordingly, in one aspect, the present invention provides double stranded ribonucleic acid (RNAi) agents for inhibiting expression of Factor XII (Hageman Factor) (F12), wherein the double stranded RNAi agent comprises a sense strand and an antisense strand, wherein the sense strand comprises at least 15 contiguous nucleotides differing by no more than 3 nucleotides from the nucleotide sequence of SEQ ID NO:9 and the antisense strand comprises at least 15 contiguous nucleotides differing by no more than 3 nucleotides from the nucleotide sequence of SEQ ID NO:10.

In another aspect, the present invention provides double stranded ribonucleic acid (RNAi) agents for inhibiting expression of a Factor XII (Hageman Factor) (F12), wherein the double stranded RNAi agent comprises a sense strand and an antisense strand, the antisense strand comprising a region of complementarity which comprises at least 15 contiguous nucleotides differing by no more than 3 nucleotides from any one of the antisense sequences listed in any one of Tables 9, 10, 19C, 19D, 20, 21, 23, 24, 26, and 27.

In another aspect, the present invention provides double stranded ribonucleic acid (RNAi) agents for inhibiting expression of a Factor XII (Hageman Factor) (F12), wherein the double stranded RNAi agent comprises a sense strand and an antisense strand, the antisense strand comprising a region of complementarity which comprises at least 15 contiguous nucleotides differing by no more than 3 nucleotides from nucleotides 2000-2060 of SEQ ID NO:9. In some embodiments, the antisense strand comprises a region of complementarity which comprises at least 15 contiguous nucleotides differing by no more than 3 nucleotides from nucleotides 2000-2030 of SEQ ID NO:9. In other embodiments, the antisense strand comprises a region of complementarity which comprises at least 15 contiguous nucleotides differing by no more than 3 nucleotides from nucleotides 2030-2060 of SEQ ID NO:9. In one embodiment, the antisense strand comprises a region of complementarity which comprises at least 15 contiguous nucleotides differing by no more than 3 nucleotides from nucleotides 2010-2040 of SEQ ID NO:9. In one embodiment, the antisense strand comprises a region of complementarity which comprises at least 15 contiguous nucleotides differing by no more than 3 nucleotides from nucleotides 2010-2035 of SEQ ID NO:9. In another embodiment, the antisense strand comprises a region of complementarity which comprises at least 15 contiguous nucleotides differing by no more than 3 nucleotides from nucleotides 2015-2040 of SEQ ID NO:9. In another embodiment, the antisense strand comprises a region of complementarity which comprises at least 15 contiguous nucleotides differing by no more than 3 nucleotides from nucleotides 2015-2045 of SEQ ID NO:9. In another embodiment, the antisense strand comprises a region of complementarity which comprises at least 15 contiguous nucleotides differing by no more than 3 nucleotides from nucleotides 2020-2050 of SEQ ID NO:9. In another embodiment, the antisense strand comprises a region of complementarity which comprises at least 15 contiguous nucleotides differing by no more than 3 nucleotides from nucleotides 2020-2045 of SEQ ID NO:9. In still other embodiments, the antisense strand comprises a region of complementarity which comprises at least 15 contiguous nucleotides differing by no more than 3 nucleotides from any one of the ranges of SEQ ID NO:9 provided in Table 24. In one embodiment, the antisense strand comprises a region of complementarity which comprises at least 15 contiguous nucleotides differing by no more than 3 nucleotides from nucleotides 2018-2040 of SEQ ID NO:9. In one embodiment, the antisense strand comprises a region of complementarity which comprises at least 15 contiguous nucleotides differing by no more than 3 nucleotides from the nucleotide sequence of the antisense strand of AD-67244

(5'-UUCAAAGCACUUUAUUGAGUUUC-3') (SEQ ID NO: 25). In one embodiment, the sense strand comprises the sense strand nucleotide sequence of AD-67244. In some embodiments, the region of complementarity comprises 15, 16, 17, 18, 19, 20, 21, 22, or 23 nucleotides differing by no more than 3 nucleotides from nucleotides 2015-2040 of SEQ ID NO:9. In some embodiments, the region of complementarity comprises 15, 16, 17, 18, 19, 20, 21, 22, or 23 nucleotides differing by no more than 3 nucleotides from nucleotides 2015-2045 of SEQ ID NO:9. In some embodiments, the region of complementarity comprises 15, 16, 17, 18, 19, 20, 21, 22, or 23 nucleotides differing by no more than 3 nucleotides from nucleotides 2018-2040 of SEQ ID NO:9. In some embodiments, the region of complementarity comprises 15, 16, 17, 18, 19, 20, 21, 22, or 23 nucleotides differing by no more than 3 nucleotides from nucleotides 2018-2045 of SEQ ID NO:9. In one embodiment, the agent comprises at least one modified nucleotide. In another embodiment, all of the nucleotides of the agent are modified nucleotides. In one embodiment, the agent further comprises a ligand, e.g., a ligand attached to the 3'-end of the sense strand. In one embodiment, the sense strand and the antisense strand are each independently 15-30 nucleotides in length. In another embodiment, the sense strand and the antisense strand are each independently 19-25 nucleotides in length.

In one aspect, the present invention provides double stranded ribonucleic acid (RNAi) agents for inhibiting expression of Kallikrein B, Plasma (Fletcher Factor) 1 (KLKB1), wherein the double stranded RNAi agent comprises a sense strand and an antisense strand, wherein the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:2.

In another aspect, the present invention provides double stranded ribonucleic acid (RNAi) agents for inhibiting expression of a Kallikrein B, Plasma (Fletcher Factor) 1 (KLKB1), wherein the double stranded RNAi agent comprises a sense strand and an antisense strand, the antisense strand comprising a region of complementarity which comprises at least 15 contiguous nucleotides differing by no more than 3 nucleotides from any one of the antisense sequences listed in any one of Tables 3, 4, 19A, or 19B.

In one aspect, the present invention provides double stranded ribonucleic acid (RNAi) agents for inhibiting expression of Kininogen 1 (KNG1), wherein the double stranded RNAi agent comprises a sense strand and an antisense strand, wherein the sense strand comprises at least 15 contiguous nucleotides differing by no more than 3 nucleotides from the nucleotide sequence of SEQ ID NO:17 and the antisense strand comprises at least 15 contiguous nucleotides differing by no more than 3 nucleotides from the nucleotide sequence of SEQ ID NO:18.

In another aspect, the present invention provides double stranded ribonucleic acid (RNAi) agents for inhibiting expression of a Kininogen 1 (KNG1), wherein the double stranded RNAi agent comprises a sense strand and an antisense strand, the antisense strand comprising a region of complementarity which comprises at least 15 contiguous nucleotides differing by no more than 3 nucleotides from any one of the antisense sequences listed in any one of Tables 15, 16, 19E, or 19F.

In one embodiment, the antisense strand comprises a region of complementarity which comprises at least 15 contiguous nucleotides differing by no more than 3 nucleotides from any one of the antisense sequences listed in any one of Tables 3, 4, 9, 10, 15, 16, 19A, 19B, 19C, 19D, 19E, 19F, 20, 21, 23, 24, 26, and 27.

In one embodiment, the double stranded RNAi agents provided herein comprise at least one modified nucleotide.

In one aspect, the present invention provides double stranded ribonucleic acid (RNAi) agents for inhibiting expression of Kallikrein B, Plasma (Fletcher Factor) 1 (KLKB1), wherein the double stranded RNAi agent comprises a sense strand and an antisense strand forming a double stranded region, wherein the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:2, wherein substantially all of the nucleotides of the sense strand and substantially all of the nucleotides of the antisense strand are modified nucleotides, and wherein the sense strand is conjugated to a ligand attached at the 3'-terminus.

In another aspect, the present invention provides double stranded ribonucleic acid (RNAi) agents for inhibiting expression of Factor XII (Hageman Factor) (F12), wherein the double stranded RNAi agent comprises a sense strand and an antisense strand forming a double stranded region, wherein the sense strand comprises at least 15 contiguous nucleotides differing by no more than 3 nucleotides from the nucleotide sequence of SEQ ID NO:9 and the antisense strand comprises at least 15 contiguous nucleotides differing by no more than 3 nucleotides from the nucleotide sequence of SEQ ID NO:10, wherein substantially all of the nucleotides of the sense strand and substantially all of the nucleotides of the antisense strand are modified nucleotides, and wherein the sense strand is conjugated to a ligand attached at the 3'-terminus.

In a further aspect, the present invention provides double stranded ribonucleic acid (RNAi) agents for inhibiting expression of Kininogen 1 (KNG1), wherein the double stranded RNAi agent comprises a sense strand and an antisense strand forming a double stranded region, wherein the sense strand comprises at least 15 contiguous nucleotides differing by no more than 3 nucleotides from the nucleotide sequence of SEQ ID NO:17 and the antisense strand comprises at least 15 contiguous nucleotides differing by no more than 3 nucleotides from the nucleotide sequence of SEQ ID NO:18, wherein substantially all of the nucleotides of the sense strand and substantially all of the nucleotides of the antisense strand are modified nucleotides, and wherein the sense strand is conjugated to a ligand attached at the 3'-terminus.

In certain embodiments, the dsRNA comprises at least one modified nucleotide. In certain embodiments, the dsRNA comprises no more than 4 (i.e., 4, 3, 2, 1, or 0) unmodified nucleotides in the sense strand. In certain embodiments, the dsRNA comprises no more than 4 (i.e., 4, 3, 2, 1, or 0) unmodified nucleotides in the antisense strand. In certain embodiments, the dsRNA comprises no more than 4 (i.e., 4, 3, 2, 1, or 0) unmodified nucleotides in both the sense strand and the antisense strand. In certain embodiments, all of the nucleotides in the sense strand of the dsRNA are modified nucleotides. In certain embodiments, all of the nucleotides in the antisense strand of the dsRNA are modified nucleotides. In certain embodiments, all of the nucleotides in the sense strand of the dsRNA and all of the nucleotides of the antisense strand are modified nucleotides.

In certain embodiments, the at least one of the modified nucleotides is selected from the group consisting of a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, and a nucleotide comprising a 5'-phosphate mimic, e.g., a vinyl phosphate.

In one embodiment, at least one of the modified nucleotides is selected from the group consisting of 2'-O-methyl and 2'fluoro modifications.

In certain embodiments, the antisense strand of the double stranded RNAi agents of any of the invention comprise no more than 8 2'-fluoro modifications, no more than 7 2'-fluoro modifications, no more than 6 2'-fluoro modifications, no more than 5 2'-fluoro modifications, no more than 4 2'-fluoro modifications, no more than 3 2'-fluoro modifications, no more than 2 2'-fluoro modifications, no more than 1 2'-fluoro modifications, or no more than 1 2'-fluoro modifications. In other embodiments, the sense strand of the double stranded RNAi agents of any of the invention comprise no more than 6 2'-fluoro modifications, no more than 5 2'-fluoro modifications, no more than 4 2'-fluoro modifications, no more than 3 2'-fluoro modifications, no more than 2 2'-fluoro modifications, no more than 1 2'-fluoro modifications, or no more than 1 2'-fluoro modifications.

In one embodiment, the double stranded RNAi agent further comprises at least one phosphorothioate internucleotide linkage. In one embodiment, the double stranded RNAi agent comprises 6-8 phosphorothioate internucleotide linkages.

The region of complementarity may be at least 17 nucleotides in length, 18 nucleotides in length, 19 nucleotides in length, 20 nucleotides in length, or 21 nucleotides in length.

In certain embodiment, the region of complementarity may be 19 to 21 nucleotides in length or 21 to 23 nucleotides in length.

In certain embodiments, each strand of the double stranded RNAi agent is no more than 30 nucleotides in length. In certain embodiments, the double stranded RNAi agent is at least 15 nucleotides in length.

In certain embodiments, at least one strand of the double stranded RNAi agent comprises a 3' overhang of at least 1 nucleotide. In certain embodiments, the at least one strand comprises a 3' overhang of at least 2 nucleotides.

In certain embodiments, the double stranded RNAi agent further comprises a ligand. In certain embodiments, the ligand is conjugated to the 3' end of the sense strand of the dsRNA. In certain embodiments, the ligand is an N-acetylgalactosamine (GalNAc) derivative. In certain embodiments, the ligand is one or more GalNAc derivatives attached through a monovalent, a bivalent or a trivalent branched linker. In certain embodiments, the ligand is

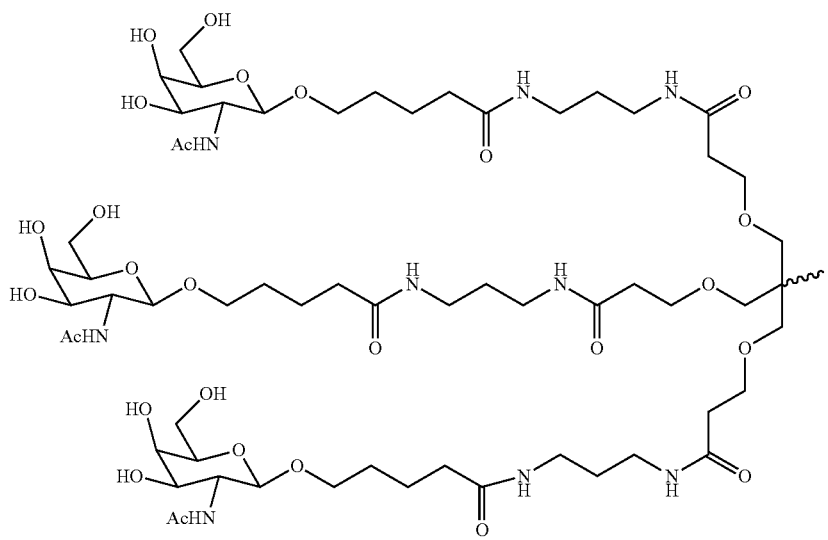

In certain embodiments, the dsRNA is conjugated to the ligand as shown in the following schematic

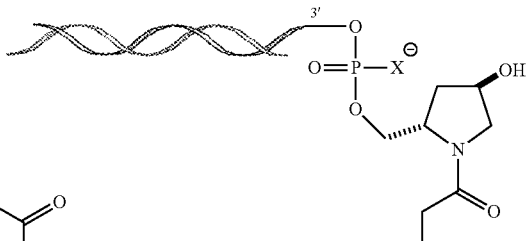
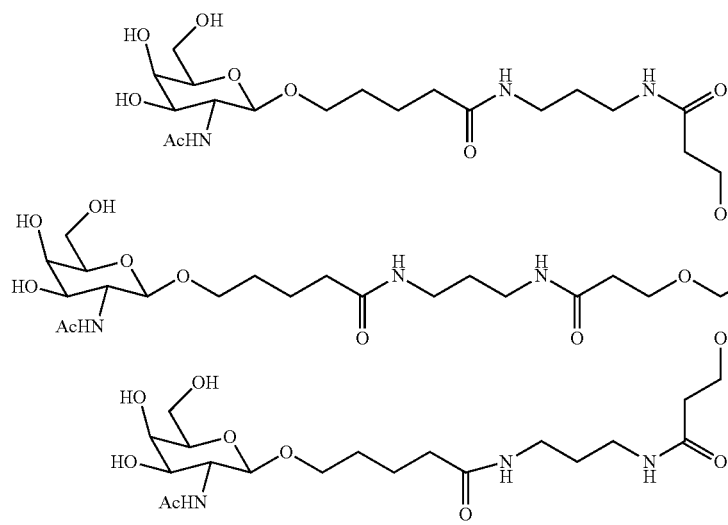

and, wherein X is O or S.

In one embodiment, the X is O.

In one embodiment, the sense and antisense sequences are selected from any one of those sequences listed in any one of Tables 3, 4, 9, 10, 15, 16, 19A, 19B, 19C, 19D, 19E, 19F, 20, 21, 23, 24, 26, and 27.

In one embodiment, the region of complementarity consists of any one of the antisense sequences listed in any one of Tables 3, 4, 9, 10, 15, 16, 19A, 19B, 19C, 19D, 19E, 19F, 20, 21, 23, 24, 26, and 27.

In one embodiment, the dsRNA agent that inhibits the expression of F12 is selected from the group consisting of AD-66170, AD-66173, AD-66176, AD-66125, AD-66172, AD-66167, AD-66165, AD-66168, AD-66163, AD-66116, AD-66126, and AD-67244. In another embodiment, the dsRNA agent that inhibits the expression of F12 is AD-67244.

In one embodiment, the dsRNA agent that inhibits the expression of KLKB1 is selected from the group consisting of AD-65077, AD-65170, AD-65103, AD-65083, AD-65087, AD-65149, AD-64652, AD-65162, AD-65153, AD-65084, AD-65099, and AD-66948. In another embodiment, the dsRNA agent that inhibits the expression of KLKB1 is AD-66948.

In one embodiment, the dsRNA agent that inhibits the expression of KNG1 is selected from the group consisting of AD-66259, AD-66261, AD-66262, AD-66263, AD-6634, and AD-67344. In another embodiment, the dsRNA agent that inhibits the expression of KNG1 is AD-67344.

In one aspect, the present invention provides cells comprising a double stranded RNAi agent of the invention targeting KLKB1. In one aspect, the present invention provides cells comprising a double stranded RNAi agent of the invention targeting F12. In a further aspect, the present invention provides cells comprising a double stranded RNAi agent of the invention targeting KNG1.

In one aspect, the present invention provides vectors encoding at least one strand of a double stranded RNAi agent of the invention targeting KLKB1. In another aspect, the present invention provides vectors encoding at least one strand of a double stranded RNAi agent of the invention targeting F12. In a further aspect, the present invention provides vectors encoding at least one strand of a double stranded RNAi agent of the invention targeting KNG1.

In one aspect, the present invention provides pharmaceutical compositions for inhibiting expression of a KLKB1 gene comprising a double stranded RNAi agent or vector of the invention. In another aspect, the present invention provides pharmaceutical compositions for inhibiting expression of a F12 gene comprising a double stranded RNAi agent or vector of the invention. In a further aspect, the present invention provides pharmaceutical compositions for inhibiting expression of a KNG1 gene comprising a double stranded RNAi agent or vector of the invention.

The pharmaceutical compositions provided herein may be administered in an unbuffered solution, e.g., saline or water, or administered with a buffer solution, e.g., a buffer solution comprising acetate, citrate, prolamine, carbonate, or phosphate or any combination thereof. In one embodiment, the buffer solution is phosphate buffered saline (PBS).

In one embodiment, the pharmaceutical compositions of the invention comprise a double stranded RNAi agent as described herein, and a lipid formulation.

In one aspect, the present invention provides methods of inhibiting KLKB1 expression in a cell. The methods include contacting the cell with a double stranded RNAi agent or a pharmaceutical composition of the invention; and maintaining the cell for a time sufficient to obtain degradation of the mRNA transcript of a KLKB1 gene, thereby inhibiting expression of the KLKB1 gene in the cell.

In another aspect, the present invention provides methods F12 expression in a cell. The methods include contacting the cell with a double stranded RNAi agent or a pharmaceutical composition of the invention; and maintaining the cell for a time sufficient to obtain degradation of the mRNA transcript of a F12 gene, thereby inhibiting expression of the F12 gene in the cell.

In a further aspect, the present invention provides methods KNG1 expression in a cell. The methods include contacting the cell with a double stranded RNAi agent or a pharmaceutical composition of the invention; and maintaining the cell for a time sufficient to obtain degradation of the mRNA transcript of a KNG1 gene, thereby inhibiting expression of the KNG1 gene in the cell.

In one embodiment, the cell is within a subject, such as a human subject.

In one embodiment, the KLKB1 expression is inhibited by at least about 30%, about 40%, about 50%, about 60%, about 70%, about 80%, about 90%, about 95%, about 98% or about 100%.

In one embodiment, the F12 expression is inhibited by at least about 30%, about 40%, about 50%, about 60%, about 70%, about 80%, about 90%, about 95%, about 98% or about 100%.

In one embodiment, the KNG1 expression is inhibited by at least about 30%, about 40%, about 50%, about 60%, about 70%, about 80%, about 90%, about 95%, about 98% or about 100%.

In one aspect, the present invention provides methods of treating a subject having a disease or disorder that would benefit from reduction in expression of a contact activation pathway gene. The methods include administering to the subject a therapeutically effective amount of a double stranded RNAi agent or pharmaceutical composition of invention, thereby treating the subject.

In one embodiment, the contact activation pathway gene is KLKB1. In another embodiment, the contact activation pathway gene is F12. In yet another embodiment, the contact activation pathway gene is KNG1.

In another aspect, the present invention provides methods of preventing at least one symptom in a subject having a disease or disorder that would benefit from reduction in expression of a contact activation pathway gene. The methods include administering to the subject a prophylactically effective amount of a double stranded RNAi agent or pharmaceutical composition of invention, thereby preventing at least one symptom in the subject having a disorder that would benefit from reduction in expression of a contact activation pathway gene.

In one embodiment, the contact activation pathway gene is KLKB1. In another embodiment, the contact activation pathway gene is F12. In yet another embodiment, the contact activation pathway gene is KNG1. In one embodiment, the contact activation pathway gene is F12 and the methods further comprise administering to the subject a double stranded RNAi agent of the invention targeting KLKB1. In another embodiment, the contact activation pathway gene is F12 and the methods further comprise administering to the subject a double stranded RNAi agent of the invention targeting KNG1.

In one embodiment, the administration of the double stranded RNAi to the subject causes a decrease in bradykinin levels or a decrease in coagulation factor XII activity.

In one embodiment, the disorder is a contact activation pathway-associated disease, such as a thrombophilia, hereditary angioedema (HAE), Fletcher Factor Deficiency, or essential hypertension.

In certain embodiment, the at least one symptom is an angioedema attack or a thrombus formation.

In one embodiment, the subject is human.

In one embodiment, the methods further comprise administering an anti-KLKB1 antibody, or antigen-binding fragment thereof, to the subject.

In one embodiment, the methods further comprise measuring bradykinin and/or coagulation factor XII levels in the subject.

In another aspect, the present invention provides methods of inhibiting the expression of F12 in a subject. The methods include administering to the subject a therapeutically effective amount of a double stranded RNAi agent of the invention targeting F12, thereby inhibiting the expression of F12 in the subject.

In one aspect, the present invention provides methods of inhibiting the expression of KLKB1 in a subject. The methods include administering to the subject a therapeutically effective amount of a double stranded RNAi agent of the invention targeting KLKB1, thereby inhibiting the expression of KLKB1 in the subject.

In one aspect, the present invention provides methods of inhibiting the expression of KNG1 in a subject. The methods include administering to the subject a therapeutically effective amount of a double stranded RNAi agent of the invention targeting KNG1, thereby inhibiting the expression of KNG1 in the subject.

In one aspect, the present invention provides methods of treating a subject having a thrombophilia. The methods include administering to the subject a therapeutically effective amount of a double stranded RNAi agent of the invention targeting F12, or a pharmaceutical composition comprising a double stranded RNAi agent of the invention targeting F12, thereby treating the subject.

In another aspect, the present invention provides methods of preventing at least one symptom in a subject having a thrombophilia. The methods include administering to the subject a prophylactically effective amount of a double stranded RNAi agent of the invention targeting F12, or a pharmaceutical composition comprising a double stranded RNAi agent of the invention targeting F12, thereby preventing at least one symptom in the subject.

In one embodiment, the methods further comprise administering to the subject a double stranded RNAi agent of the invention targeting KLKB1. In another embodiment, the methods further comprise administering to the subject a double stranded RNAi agent of the invention targeting KNG1.

In one aspect, the present invention provides methods of treating a subject having hereditary angioedema (HAE). The methods include administering to the subject a therapeutically effective amount of a double stranded RNAi agent of the invention targeting F12, or a pharmaceutical composition comprising a double stranded RNAi agent of the invention targeting F12, thereby treating the subject.

In another aspect, the present invention provides methods of preventing at least one symptom in a subject having hereditary angioedema (HAE). The methods include administering to the subject a prophylactically effective amount of a double stranded RNAi agent of the invention targeting F12, or a pharmaceutical composition comprising a double stranded RNAi agent of the invention targeting F12, thereby preventing at least one symptom in the subject.

In one embodiment, the methods further comprise administering to the subject a double stranded RNAi agent of the invention targeting KLKB1. In another embodiment, the methods further comprise administering to the subject a double stranded RNAi agent of the invention targeting KNG1.

In another aspect, the present invention provides methods of preventing the formation of a thrombus in a subject at risk of forming a thrombus. The methods include administering to the subject a prophylactically effective amount of a double stranded RNAi agent of the invention targeting F12, or a pharmaceutical composition comprising a double stranded RNAi agent of the invention targeting F12, thereby inhibiting formation of a thrombus in the subject at risk of forming a thrombus.

In one embodiment, the subject at risk of forming a thrombus has a contact activation pathway-associated disease or disorder.

In one embodiment, the contact activation pathway-associated disease is thrombophilia.

In another embodiment, the contact activation pathway-associated disease is hereditary angioedema (HAE).

In other embodiments, the contact activation pathway-associated disease is Fletcher Factor Deficiency or essential hypertension.

In one embodiment, the subject at risk of forming a thrombus is selected from the group consisting of a surgical patient; a medical patient; a pregnant subject; a postpartum subject; a subject that has previously had a thrombus; a subject undergoing hormone replacement therapy; a subject sitting for long periods; and an obese subject.

In one embodiment, the methods further comprise administering to the subject a double stranded RNAi agent of the invention targeting KLKB1. In another embodiment, the methods further comprise administering to the subject a double stranded RNAi agent of the invention targeting KNG1.

In another aspect, the present invention provides methods of preventing an angioedema attack in a subject having hereditary angioedema (HAE). The methods include administering to the subject a prophylactically effective amount of a double stranded RNAi agent of the invention targeting F12, or a pharmaceutical composition comprising a double stranded RNAi agent of the invention targeting F12, thereby preventing an angioedema attack.

In one embodiment, the methods further comprise administering to the subject a double stranded RNAi agent of the invention targeting KLKB1. In another embodiment, the methods further comprise administering to the subject a double stranded RNAi agent of the invention targeting KNG1.

BRIEF DESCRIPTION OF THE DRAWINGS

FIG. 6A is a graph depicting the amount of Evans blue dye in the blood of mice administered a single 0 mg/kg, 0.3 mg/kg, 1 mg/kg, 3 mg/kg, or 10 mg/kg dose of AD-67344 and captopril at day 7 post-dose.

FIG. 6B is a graph depicting the amount of Evans blue dye in the intestines of mice administered a single 0 mg/kg, 0.3 mg/kg, 1 mg/kg, 3 mg/kg, or 10 mg/kg dose of AD-67344 and captopril at day 7 post-dose.

FIG. 6C is a graph depicting KNG1 mRNA suppression in the liver of mice administered a single 0 mg/kg, 0.3 mg/kg, 1 mg/kg, 3 mg/kg, or 10 mg/kg dose of AD-67344 and captopril at day 7 post-dose.

FIG. 6D is a graph depicting the relative permeability of the intestine in mice administered a single 0 mg/kg, 0.3 mg/kg, 1 mg/kg, 3 mg/kg, or 10 mg/kg dose of AD-67344 and captopril at day 7 post-dose.

DETAILED DESCRIPTION OF THE INVENTION

Figure 1:
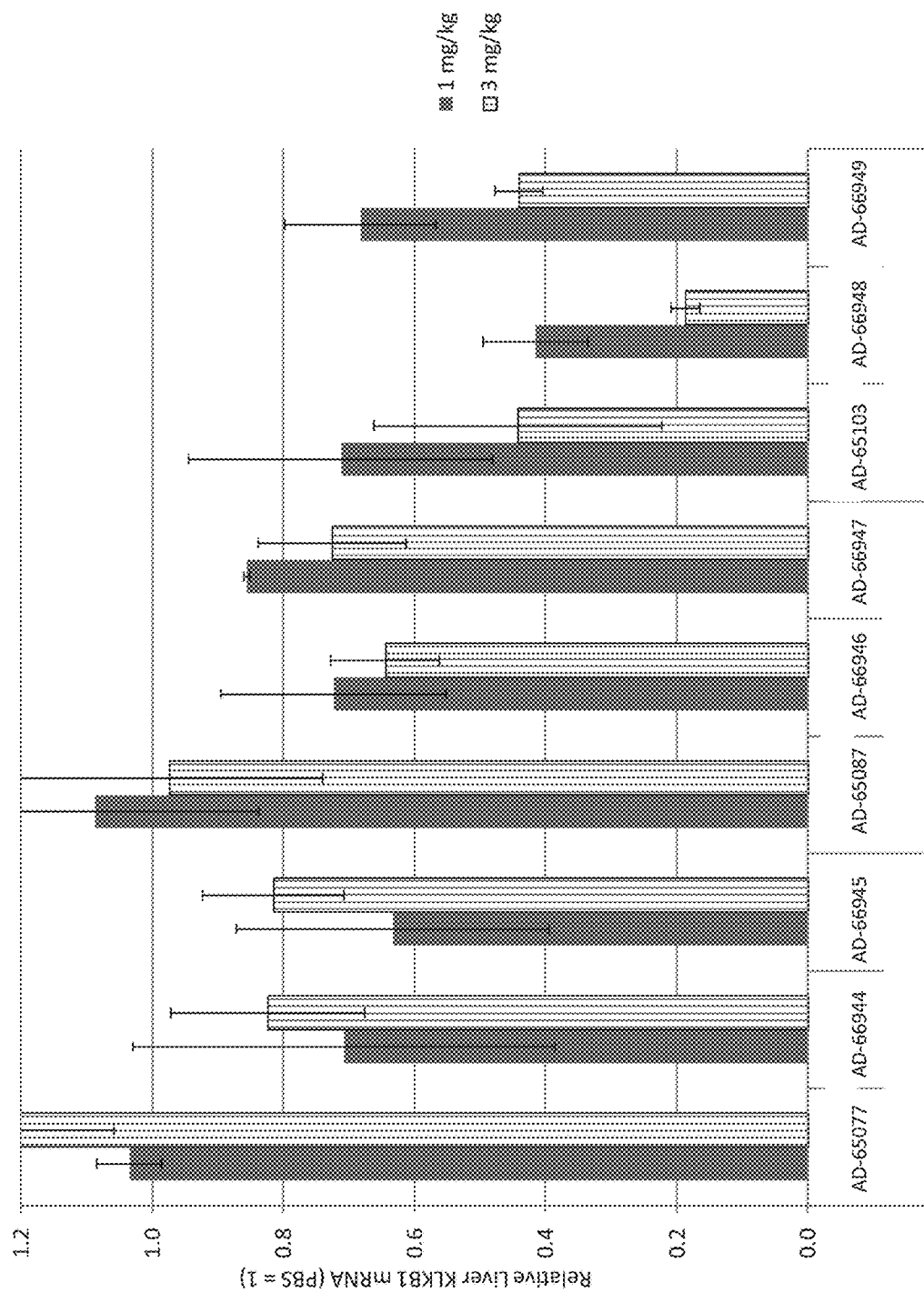
FIG. 1 is a graph depicting KLKB1 mRNA suppression following a single subcutaneous 1 mg/kg or 3 mg/kg dose of the indicated agents at 7-10 days post-dose in wild-type mice.

The present invention provides iRNA compositions which effect the RNA-induced silencing complex (RISC)-mediated cleavage of RNA transcripts of a contact activation pathway gene (i.e., Kallikrein B, Plasma (Fletcher Factor) 1 (KLKB1) gene, a "Factor XII (Hageman Factor) (F12) gene, or a Kininogen 1 (KNG1) gene). The gene may be within a cell, e.g., a cell within a subject, such as a human. The use of these iRNAs enables the targeted degradation of mRNAs of the corresponding gene (the KLKB1 gene, the F12 gene, or the KNG1 gene) in mammals.

The RNAi agents of the invention have been designed to target protein-coding and 3' UTR regions in the human KLKB1 gene, including portions of the gene that are conserved in the KLKB1 orthologs of other mammalian species. Without intending to be limited by theory, it is believed that a combination or sub-combination of the foregoing properties and the specific target sites and/or the specific modifications in these RNAi agents confer to the RNAi agents of the invention improved efficacy, stability, potency, durability, and safety.

The iRNAs of the invention may include an RNA strand (the antisense strand) having a region which is about 30 nucleotides or less in length, e.g., 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of a contact activation pathway gene, i.e., the KLKB1 gene, the F12 gene, or the KNG1 gene.

In certain embodiments, the iRNAs of the invention include an RNA strand (the antisense strand) which can include longer lengths, for example up to 66 nucleotides, e.g., 36-66, 26-36, 25-36, 31-60, 22-43, 27-53 nucleotides in length with a region of at least 19 contiguous nucleotides that is substantially complementary to at least a part of an mRNA transcript of a contact activation pathway gene, i.e., the KLKB1 gene, the F12 gene, or the KNG1 gene. These iRNAs with the longer length antisense strands preferably include a second RNA strand (the sense strand) of 20-60 nucleotides in length wherein the sense and antisense strands form a duplex of 18-30 contiguous nucleotides.

Using in vitro and in vivo assays, the present inventors have demonstrated that iRNAs targeting a contact activation pathway gene can potently mediate RNAi, resulting in significant inhibition of expression the contact activation pathway gene, i.e., the KLKB1 gene, the F12 gene, or the KNG1 gene. The present inventors have also demonstrated that the RNAi agents of the invention are exceptionally stable in the cytoplasm and lysosome. Thus, methods and compositions including these iRNAs are useful for treating a subject having a contact activation pathway-associated disease or disorder, e.g., a thrombophilia, HAE, and for preventing at least one symptom in a subject having a contact activation pathway-associated disease or disorder or a subject at risk of developing a contact activation pathway-associated disease or disorder.

Accordingly, the present invention also provides methods for treating a subject having a disorder that would benefit from inhibiting or reducing the expression of a contact activation pathway gene, e.g., a contact activation pathway-associated disease, such as a thrombophilia or hereditary angioedema (HAE), using iRNA compositions which effect the RNA-induced silencing complex (RISC)-mediated cleavage of RNA transcripts of a contact activation pathway gene.

Very low dosages of the iRNAs of the invention, in particular, can specifically and efficiently mediate RNA interference (RNAi), resulting in significant inhibition of expression of the corresponding gene (contact activation pathway gene).

The following detailed description discloses how to make and use compositions containing iRNAs to inhibit the expression of a contact activation pathway gene (i.e., a KLKB1 gene, an F12 gene, or a KNG1 gene) as well as compositions, uses, and methods for treating subjects having diseases and disorders that would benefit from inhibition and/or reduction of the expression of a contact activation pathway gene (i.e., a KLKB1 gene, an F12 gene, or a KNG1 gene).

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to".

The term "or" is used herein to mean, and is used interchangeably with, the term "and/or," unless context clearly indicates otherwise.

The term "at least" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 18 nucleotides of a 21 nucleotide nucleic acid molecule" means that 18, 19, 20, or 21 nucleotides have the indicated property. When at least is present before a series of numbers or a range, it is understood that "at least" can modify each of the numbers in the series or range.

As used herein, ranges include both the upper and lower limit.

As used herein, "Kallikrein B, Plasma (Fletcher Factor) 1," used interchangeably with the terms "Prekallikrein" and "KLKB1," refers to the naturally occurring gene that encodes the zymogen form of kallikrein, prekallikrein. Plasma prekallikrein is converted to plasma kallikrein (also referred to as active kallikrein) by F12a and proteolytically releases bradykinin from high-molecular weight kininogen and activates F12. Bradykinin is a peptide that enhances vascular permeability and is present in elevated levels in HAE patients. The amino acid and complete coding sequences of the reference sequence of the KLKB1 gene may be found in, for example, GenBank Accession No. GI:78191797 (RefSeq Accession No. NM_000892.3; SEQ ID NO:1; SEQ ID NO:2). Mammalian orthologs of the human KLKB1 gene may be found in, for example, GenBank Accession Nos. GI:544436072 (RefSeq Accession No. XM_005556482, cynomolgus monkey; SEQ ID NO:7 and SEQ ID NO:8); GI:380802470 (RefSeq Accession No. JU329355, rhesus monkey); GI:236465804 (RefSeq Accession No. NM_008455, mouse; SEQ ID NO:3 and SEQ ID NO:4); GI:162138904 (RefSeq Accession No. NM_012725, rat; SEQ ID NO:5 and SEQ ID NO:6).

Additional examples of KLKB1 mRNA sequences are readily available using publicly available databases, e.g., GenBank, UniProt, and OMIM.

As used herein, "Factor XII (Hageman Factor)," used interchangeably with the terms "coagulation factor XII," "FXII," "F12," active F12," and "F12a," refers to the naturally occurring gene that encodes the zymogen form of F12a. F12 a is an enzyme (EC 3.4.21.38) of the serine protease (or serine endopeptidase) class that cleaves prekallikrein to form kallikrein, which subsequently releases bradykinin from high-molecular weight kininogen and activates F12. The amino acid and complete coding sequences of the reference sequence of the F12 gene may be found in, for example, GenBank Accession No. GI:145275212 (RefSeq Accession No. NM_000505; SEQ ID NO:9; SEQ ID NO:10). Mammalian orthologs of the human F12 gene may be found in, for example, GenBank Accession Nos. GI:544441267 (RefSeq Accession No. XM_005558647, cynomolgus monkey; SEQ ID NO:11 and SEQ ID NO:12); GI:805299477 (RefSeq Accession No. NM_021489, mouse; SEQ ID NO:13 and SEQ ID NO:14); GI:62078740 (RefSeq Accession No. NM_001014006, rat; SEQ ID NO:15 and SEQ ID NO:16).

Additional examples of F12 mRNA sequences are readily available using publicly available databases, e.g., GenBank, UniProt, and OMIM.

As used herein, "Kininogen 1," used interchangeably with the terms "Fitzgerald Factor," "Williams-Fitzgerald-Flaujeac Factor," "high-molecular weight kininogen" ("HMWK" or "HK"), "low-molecular weight kininogen" ("LMWK)", and "KNG1," refers to the naturally occurring gene that is alternatively spliced to generate HMWK and LMWK. Cleavage of HMWK by active kallikrein releases bradykinin. The amino acid and complete coding sequences of the reference sequence of the KNG1 gene may be found in, for example, GenBank Accession No. GI:262050545 (RefSeq Accession No. NM_001166451; SEQ ID NO:17; SEQ ID NO:18). Mammalian orthologs of the human KNG1 gene may be found in, for example, GenBank Accession Nos. GI:544410550 (RefSeq Accession No. XM_005545463, cynomolgus monkey; SEQ ID NO:19 and SEQ ID NO:20); GI: 156231028 (RefSeq Accession No. NM_001102409, mouse; SEQ ID NO:21 and SEQ ID NO:22); GI:80861400 (RefSeq Accession No. NM_012696, rat; SEQ ID NO:23 and SEQ ID NO:23).

Additional examples of KNG1 mRNA sequences are readily available using publicly available databases, e.g., GenBank, UniProt, and OMIM.

For simplicity, as used herein, unless otherwise specified, a "contact activation pathway gene" refers to a KLKB1 gene, an F12 gene, or a KNG1 gene.

As used herein, "target sequence" refers to a contiguous portion of the nucleotide sequence of an mRNA molecule formed during the transcription of a contact activation pathway gene, including mRNA that is a product of RNA processing of a primary transcription product. In one embodiment, the target portion of the sequence will be at least long enough to serve as a substrate for iRNA-directed cleavage at or near that portion of the nucleotide sequence of an mRNA molecule formed during the transcription of a contact activation pathway gene. In one embodiment, the target sequence is within the protein coding region of the contact activation pathway gene. In another embodiment, the target sequence is within the 3' UTR of the contact activation pathway gene.

The target sequence may be from about 9-36 nucleotides in length, e.g., about 15-30 nucleotides in length. For example, the target sequence can be from about 15-30 nucleotides, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 nucleotides in length. In some embodiments, the target sequence is about 19 to about 30 nucleotides in length. In other embodiments, the target sequence is about 19 to about 25 nucleotides in length. In still other embodiments, the target sequence is about 19 to about 23 nucleotides in length. In some embodiments, the target sequence is about 21 to about 23 nucleotides in length. Ranges and lengths intermediate to the above recited ranges and lengths are also contemplated to be part of the invention.

As used herein, the term "strand comprising a sequence" refers to an oligonucleotide comprising a chain of nucleotides that is described by the sequence referred to using the standard nucleotide nomenclature.

"G," "C," "A," "T" and "U" each generally stand for a nucleotide that contains guanine, cytosine, adenine, thymidine and uracil as a base, respectively. However, it will be understood that the term "ribonucleotide" or "nucleotide" can also refer to a modified nucleotide, as further detailed below, or a surrogate replacement moiety (see, e.g., Table 2). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA", "RNAi agent," "iRNA agent,", "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of a KLKB1 gene in a cell, e.g., a cell within a subject, such as a mammalian subject.

In one embodiment, an RNAi agent of the invention includes a single stranded RNA that interacts with a target RNA sequence, e.g., a contact activation pathway gene, i.e., a KLKB1 target mRNA sequence, an F12 target mRNA sequence, or a KNG1 target mRNA sequence, to direct the cleavage of the target RNA. Without wishing to be bound by theory it is believed that long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the invention relates to a single stranded RNA (siRNA) generated within a cell and which promotes the formation of a RISC complex to effect silencing of the target gene, i.e., a contact activation pathway gene. Accordingly, the term "siRNA" is also used herein to refer to an RNAi as described above.

In another embodiment, the RNAi agent may be a single-stranded siRNA that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded siRNAs are described in U.S. Pat. No. 8,101,348 and in Lima et al., (2012) *Cell* 150:883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150:883-894.

In another embodiment, an "iRNA" for use in the compositions, uses, and methods of the invention is a double stranded RNA and is referred to herein as a "double stranded RNAi agent," "double stranded RNA (dsRNA) molecule," "dsRNA agent," or "dsRNA". The term "dsRNA", refers to a complex of ribonucleic acid molecules, having a duplex structure comprising two anti-parallel and substantially complementary nucleic acid strands, referred to as having "sense" and "antisense" orientations with respect to a target RNA, i.e., a contact activation pathway gene, i.e., a KLKB1 gene, an F12 gene, or a KNG1 gene. In some embodiments of the invention, a double stranded RNA (dsRNA) triggers the degradation of a target RNA, e.g., an mRNA, through a post-transcriptional gene-silencing mechanism referred to herein as RNA interference or RNAi.

In general, the majority of nucleotides of each strand of a dsRNA molecule are ribonucleotides, but as described in detail herein, each or both strands can also include one or more non-ribonucleotides, e.g., a deoxyribonucleotide and/or a modified nucleotide. In addition, as used in this specification, an "RNAi agent" may include ribonucleotides with chemical modifications; an RNAi agent may include substantial modifications at multiple nucleotides. As used herein, the term "modified nucleotide" refers to a nucleotide having, independently, a modified sugar moiety, a modified internucleotide linkage, and/or modified nucleobase. Thus, the term modified nucleotide encompasses substitutions, additions or removal of, e.g., a functional group or atom, to internucleoside linkages, sugar moieties, or nucleobases. The modifications suitable for use in the agents of the invention include all types of modifications disclosed herein or known in the art. Any such modifications, as used in a siRNA type molecule, are encompassed by "RNAi agent" for the purposes of this specification and claims.

The duplex region may be of any length that permits specific degradation of a desired target RNA through a RISC pathway, and may range from about 9 to 36 base pairs in length, e.g., about 15-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 2, at least 3, at least 4, at least 5, at least 6, at least 7, at least 8, at least 9, at least 10, at least 20, at least 23 or more unpaired nucleotides.

Where the two substantially complementary strands of a dsRNA are comprised by separate RNA molecules, those molecules need not, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs.

In one embodiment, an RNAi agent of the invention is a dsRNA of 24-30 nucleotides that interacts with a target RNA sequence, e.g., a contact activation pathway gene, i.e., a KLKB1 target mRNA sequence, an F12 target mRNA sequence, or a KNG1 target mRNA sequence, to direct the cleavage of the target RNA. Without wishing to be bound by theory, long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188).

As used herein, the term "nucleotide overhang" refers to at least one unpaired nucleotide that protrudes from the duplex structure of an iRNA, e.g., a dsRNA. For example, when a 3'-end of one strand of a dsRNA extends beyond the 5'-end of the other strand, or vice versa, there is a nucleotide overhang. A dsRNA can comprise an overhang of at least one nucleotide; alternatively the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

In one embodiment, the antisense strand of a dsRNA has a 1-10 nucleotide, e.g., a 1, 2, 3, 4, 5, 6, 7, 8, 9, or 10 nucleotide, overhang at the 3'-end and/or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end and/or the 5'-end. In another embodiment, one or more of the nucleotides in the overhang is replaced with a nucleoside thiophosphate.

In certain embodiments, the overhang on the sense strand or the antisense strand, or both, can include extended lengths longer than 10 nucleotides, e.g., 1-30 nucleotides, 2-30 nucleotides, 10-30 nucleotides, or 10-15 nucleotides in length. In certain embodiments, an extended overhang is on the sense strand of the duplex. In certain embodiments, an extended overhang is present on the 3'end of the sense strand of the duplex. In certain embodiments, an extended overhang is present on the 5'end of the sense strand of the duplex. In certain embodiments, an extended overhang is on the antisense strand of the duplex. In certain embodiments, an extended overhang is present on the 3'end of the antisense strand of the duplex. In certain embodiments, an extended overhang is present on the 5'end of the antisense strand of the duplex. In certain embodiments, one or more of the nucleotides in the overhang is replaced with a nucleoside thiophosphate. In certain embodiments, the overhang includes a self-complementary portion such that the overhang is capable of forming a hairpin structure that is stable under physiological conditions.

"Blunt" or "blunt end" means that there are no unpaired nucleotides at that end of the double stranded RNAi agent, i.e., no nucleotide overhang. A "blunt ended" RNAi agent is a dsRNA that is double stranded over its entire length, i.e., no nucleotide overhang at either end of the molecule. The RNAi agents of the invention include RNAi agents with nucleotide overhangs at one end (i.e., agents with one overhang and one blunt end) or with nucleotide overhangs at both ends.

The term "antisense strand" or "guide strand" refers to the strand of an iRNA, e.g., a dsRNA, which includes a region that is substantially complementary to a target sequence, e.g., a KLKB1 mRNA. As used herein, the term "region of complementarity" refers to the region on the antisense strand that is substantially complementary to a sequence, for example a target sequence, e.g., a contact activation pathway gene nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, 3, 2, or 1 nucleotides of the 5'- and/or 3'-terminus of the iRNA. In one embodiment, a double stranded RNAi agent of the invention include a nucleotide mismatch in the antisense strand. In another embodiment, a double stranded RNAi agent of the invention include a nucleotide mismatch in the sense strand. In one embodiment, the nucleotide mismatch is, for example, within 5, 4, 3, 2, or 1 nucleotides from the 3'-terminus of the iRNA. In another embodiment, the nucleotide mismatch is, for example, in the 3'-terminal nucleotide of the iRNA.

The term "sense strand," or "passenger strand" as used herein, refers to the strand of an iRNA that includes a region that is substantially complementary to a region of the antisense strand as that term is defined herein.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3 or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs and/or base pairs formed from non-natural and modified nucleotides, in so far as the above requirements with respect to their ability to hybridize are fulfilled. Such non-Watson-Crick base pairs include, but are not limited to, G:U Wobble or Hoogstein base pairing.

The terms "complementary," "fully complementary" and "substantially complementary" herein can be used with respect to the base matching between the sense strand and the antisense strand of a dsRNA, or between the antisense strand of an iRNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding a contact activation pathway gene). For example, a polynucleotide is complementary to at least a part of a KLKB1 mRNA if the sequence is substantially complementary to a non-interrupted portion of an mRNA encoding a KLKB1 gene.

Accordingly, in some embodiments, the sense strand polynucleotides and the antisense polynucleotides disclosed herein are fully complementary to the target contact activation pathway gene sequence.

In one embodiment, the antisense polynucleotides disclosed herein are fully complementary to the target KLKB1 sequence. In other embodiments, the antisense polynucleotides disclosed herein are substantially complementary to the target KLKB1 sequence and comprise a contiguous nucleotide sequence which is at least about 80% complementary over its entire length to the equivalent region of the nucleotide sequence of any one of SEQ ID Nos:1 and 2, or a fragment of any one of SEQ ID Nos:1 and 2, such as about 85%, about 86%, about 87%, about 88%, about 89%, about 90%, about % 91%, about 92%, about 93%, about 94%, about 95%, about 96%, about 97%, about 98%, or about 99% complementary.

In other embodiments, the antisense polynucleotides disclosed herein are substantially complementary to the target KLKB1 sequence and comprise a contiguous nucleotide sequence which is at least about 80% complementary over its entire length to any one of the sense strand nucleotide sequences in any one of Tables 3, 4, 19A, or 19B, or a fragment of any one of the antisense strand nucleotide sequences in any one of Tables 3, 4, 19A, or 19B, such as about 85%, about 86%, about 87%, about 88%, about 89%, about 90%, about % 91%, about 92%, about 93%, about 94%, about 95%, about 96%, about 97%, about 98%, or about 99% complementary.

In one embodiment, an RNAi agent of the invention includes a sense strand that is substantially complementary to an antisense polynucleotide which, in turn, is complementary to a target KLKB1 sequence and comprises a contiguous nucleotide sequence which is at least about 80% complementary over its entire length to any one of the antisense strand nucleotide sequences in any one of Tables 3, 4, 19A, or 19B, or a fragment of any one of the antisense strand nucleotide sequences in any one of Tables 3, 4, 19A, or 19B, such as about 85%, about 86%, about 87%, about 88%, about 89%, about 90%, about % 91%, about 92%, about 93%, about 94%, about 95%, about 96%, about 97%, about 98%, or about 99% complementary.

In one embodiment, the antisense polynucleotides disclosed herein are fully complementary to the target F12 sequence. In other embodiments, the antisense polynucleotides disclosed herein are substantially complementary to the target F12 sequence and comprise a contiguous nucleotide sequence which is at least about 80% complementary over its entire length to the equivalent region of the nucleotide sequence of SEQ ID Nos:9 or 10, or a fragment of SEQ ID Nos:9 or 10, such as about 85%, about 86%, about 87%, about 88%, about 89%, about 90%, about % 91%, about 92%, about 93%, about 94%, about 95%, about 96%, about 97%, about 98%, or about 99% complementary.

In other embodiment, the antisense strand polynucleotides are substantially complementary to the target F12 sequence and comprise a contiguous nucleotide sequence which is at least about 80% complementary over its entire length to any one of the sense strand nucleotide sequences in any one of Tables 9, 10, 19C, 19D, 20, 21, 23, 24, 26, and 27, or a fragment of any one of the antisense strand nucleotide sequences in any one of Tables 9, 10, 19C, 19D, 20, 21, 23, 24, 26, and 27, such as about 85%, about 86%, about 87%, about 88%, about 89%, about 90%, about % 91%, about 92%, about 93%, about 94%, about 95%, about 96%, about 97%, about 98%, or about 99% complementary.

In one embodiment, an RNAi agent of the invention includes a sense strand that is substantially complementary to an antisense polynucleotide which, in turn, is complementary to a target F12 sequence and comprise a contiguous nucleotide sequence which is at least about 80% complementary over its entire length to any one of antisense strand nucleotide sequences in any one of Tables 9, 10, 19C, 19D, 20, 21, 23, 24, 26, and 27, or a fragment of any one of the antisense strand nucleotide sequences in any one of Tables 9, 10, 19C, 19D, 20, 21, 23, 24, 26, and 27, such as about 85%, about 86%, about 87%, about 88%, about 89%, about 90%, about % 91%, about 92%, about 93%, about 94%, about 95%, about 96%, about 97%, about 98%, or about 99% complementary.

In one embodiment, the sense strand polynucleotides and the antisense polynucleotides disclosed herein are fully complementary to the target KNG1 sequence. In other embodiments, the sense strand polynucleotides and/or the antisense polynucleotides disclosed herein are substantially complementary to the target KNG1 sequence and comprise a contiguous nucleotide sequence which is at least about 80% complementary over its entire length to the equivalent region of the nucleotide sequence of SEQ ID Nos:17 or 18, or a fragment of SEQ ID Nos:17 or 18, such as about 85%, about 86%, about 87%, about 88%, about 89%, about 90%, about % 91%, about 92%, about 93%, about 94%, about 95%, about 96%, about 97%, about 98%, or about 99% complementary.

In other embodiment, the antisense strand polynucleotides are substantially complementary to the target KNG sequence and comprise a contiguous nucleotide sequence which is at least about 80% complementary over its entire length to any one of the sense strand nucleotide sequences in any one of 15 or 16, such as about 85%, about 86%, about 87%, about 88%, about 89%, about 90%, about % 91%, about 92%, about 93%, about 94%, about 95%, about 96%, about 97%, about 98%, or about 99% complementary.

In one embodiment, an RNAi agent of the invention includes a sense strand that is substantially complementary to an antisense polynucleotide which, in turn, is complementary to a target KNG1 sequence and comprises a contiguous nucleotide sequence which is at least about 80% complementary over its entire length to any one of the antisense strand nucleotide sequences in Table 15 or 16, or a fragment of any one of the antisense strand nucleotide sequences in Table 15 or 16, such as about 85%, about 86%, about 87%, about 88%, about 89%, about 90%, about % 91%, about 92%, about 93%, about 94%, about 95%, about 96%, about 97%, about 98%, or about 99% complementary.

In general, the majority of nucleotides of each strand are ribonucleotides, but as described in detail herein, each or both strands can also include one or more non-ribonucleotides, e.g., a deoxyribonucleotide and/or a modified nucleotide. In addition, an "iRNA" may include ribonucleotides with chemical modifications. Such modifications may include all types of modifications disclosed herein or known in the art. Any such modifications, as used in an iRNA molecule, are encompassed by "iRNA" for the purposes of this specification and claims.

In one aspect of the invention, an agent for use in the methods and compositions of the invention is a single-stranded antisense RNA molecule that inhibits a target mRNA via an antisense inhibition mechanism. The single-stranded antisense RNA molecule is complementary to a sequence within the target mRNA. The single-stranded antisense oligonucleotides can inhibit translation in a stoichiometric manner by base pairing to the mRNA and physically obstructing the translation machinery, see Dias, N. et al., (2002) *Mol Cancer Ther* 1:347-355. The single-stranded antisense RNA molecule may be about 15 to about 30 nucleotides in length and have a sequence that is complementary to a target sequence. For example, the single-stranded antisense RNA molecule may comprise a sequence that is at least about 15, 16, 17, 18, 19, 20, or more contiguous nucleotides from any one of the antisense sequences described herein.

As used herein, a "subject" is an animal, such as a mammal, including a primate (such as a human, a non-human primate, e.g., a monkey, and a chimpanzee), a non-primate (such as a cow, a pig, a camel, a llama, a horse, a goat, a rabbit, a sheep, a hamster, a guinea pig, a cat, a dog, a rat, a mouse, a horse, and a whale), or a bird (e.g., a duck or a goose). In an embodiment, the subject is a human, such as a human being treated or assessed for a disease, disorder or condition that would benefit from reduction in contact activation pathway gene expression (i.e., KLKB1 gene expression, F12 gene expression, and/or KNG1 gene expression) and/or replication; a human at risk for a disease, disorder or condition that would benefit from reduction in contact activation pathway gene expression; a human having a disease, disorder or condition that would benefit from reduction in contact activation pathway gene expression; and/or human being treated for a disease, disorder or condition that would benefit from reduction in contact activation pathway gene expression, as described herein.

As used herein, the terms "treating" or "treatment" refer to a beneficial or desired result including, but not limited to, alleviation or amelioration of one or more symptoms associated with contact activation pathway gene expression (i.e., KLKB1 gene expression, F12 gene expression, and/or KNG1 gene expression) and/or contact activation pathway protein production (i.e., KLKB1 protein production, F12 protein production, and/or KNG1 protein production), e.g., a thrombophilia, e.g., the formation of a thrombus, the presence of elevated bradykinin, heredity angioedema (HAE), such as hereditary angioedema type I; hereditary angioedema type II; hereditary angioedema type III; or any other hereditary angioedema caused by elevated levels of bradykinin, an angioedema attack, edema swelling of the extremities, face, larynx, upper respiratory tract, abdomen, trunk, and genitals, prodrome; laryngeal swelling; nonpruritic rash; nausea; vomiting; abdominal pain. "Treatment" can also mean prolonging survival as compared to expected survival in the absence of treatment.

The term "lower" in the context of the level of contact activation pathway gene expression and/or contact activation pathway protein production in a subject or a disease marker or symptom refers to a statistically significant decrease in such level. The decrease can be, for example, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more and is preferably down to a level accepted as within the range of normal for an individual without such disorder.

As used herein, "prevention" or "preventing," when used in reference to a disease, disorder or condition thereof, that would benefit from a reduction in expression of a contact activation pathway gene and/or production of a contact activation pathway protein, refers to a reduction in the likelihood that a subject will develop a symptom associated with such a disease, disorder, or condition, or a reduction in the frequency and/or duration of a symptom associated with such a disease, disorder, or condition, e.g., a symptom of contact activation pathway gene expression, such as the formation of a venous thrombus, an arterial thrombus, a cardiac chamber thrombus, a thromboembolism, the presence of elevated bradykinin, an angioedema attack, hereditary angioedema type I; hereditary angioedema type II; hereditary angioedema type III; any other hereditary angioedema caused by elevated levels of bradykinin; edema swelling of the extremities, face, larynx, upper respiratory tract, abdomen, trunk, and genitals, prodrome; laryngeal swelling; nonpruritic rash; nausea; vomiting; abdominal pain. The failure to develop a disease, disorder or condition, or the reduction in the development of a symptom associated with such a disease, disorder or condition (e.g., by at least about 10% on a clinically accepted scale for that disease or disorder), or the exhibition of delayed symptoms delayed (e.g., by days, weeks, months or years) is considered effective prevention.

As used herein, the term "contact activation pathway-associated disease," is a disease or disorder that is caused by, or associated with contact activation pathway gene expression (i.e., KLKB1 gene expression, F12 gene expression, and/or KNG1 gene expression) or contact activation pathway protein production (i.e., KLKB1 protein production, F12 protein production, and/or KNG1 protein production). The term "contact activation pathway-associated disease" includes a disease, disorder or condition that would benefit from reduction in contact activation pathway gene expression and/or contact activation pathway protein activity. A contact activation pathway-associated disease may be a genetic disorder or an acquired disorder.

Non-limiting examples of contact activation pathway-associated diseases include, for example, thrombophilia, heredity angioedema (HAE) (such as hereditary angioedema type I; hereditary angioedema type II; hereditary angioedema type III; or any other hereditary angioedema caused by elevated levels of bradykinin), prekallikrein deficiency (inherited or acquired), also known as Fletcher Factor Deficiency, malignant essential hypertension, hypertension, end stage renal disease.

In one embodiment, the contact activation pathway-associated disease is a thrombophilia. As used herein, the term "thrombophilia," also referred to as "hypercoagulability" or "a prothrombotic state", is any disease or disorder associated with an abnormality of blood coagulation that increases the risk of thrombosis and the development of a thrombus. As used herein, the term "thrombosis" refers to the process of local coagulation or clotting of the blood (formation of a "thrombus" or "clot") in a part of the circulatory system. A thrombophilia may be inherited, acquired, or the result on an environmental condition. Exemplary inherited thrombophilias include inherited antithrombin deficiency, inherited Protein C deficiency, inherited Protein S deficiency, inherited Factor V Leiden thrombophilia, and Prothrombin (Factor II) G20210A. An exemplary acquired thrombophilia includes Antiphospholipid syndrome. Acquired/environmentally acquired thrombophilias may be the result of, for example trauma, fracture, surgery, e.g., orthopedic surgery, oncological surgery, oral contraceptive use, hormone replacement therapy, pregnancy, puerperium, hypercoaguability, previous thrombus, age, immobilization (e.g., more than three days of bed rest), prolonged travel, metabolic syndrome, and air pollution (see, e.g., Previtali, et al. (2011) *Blood Transfus* 9:120).

Accordingly, "subjects at risk of forming a thrombus" include surgical patients (e.g., subjects having general surgery, dental surgery, orthopedic surgery (e.g., knee or hip replacement surgery), trauma surgery, oncological surgery); medical patients (e.g., subjects having an immobilizing disease, e.g., subjects having more than three days of bed rest and/or subjects having long-term use of an intravenous catheter; subjects having atrial fibrillation; elderly subjects; subjects having renal impairment; subjects having a prosthetic heart valve; subjects having heart failure; subjects having cancer); pregnant subjects; postpartum subjects; subjects that have previously had a thrombus; subjects undergoing hormone replacement therapy; subjects sitting for long periods of time, such as in a plane or car; and obese subjects.

In one embodiment, the contact activation pathway-associated disease is hereditary angioedema (HAE). As used herein, "hereditary angioedema," used interchangeably with the term "HAE," refers to an autosomal dominant disorder caused by mutation of the C1 inhibitor (C1INH), SERPING1) gene or the coagulation factor XII (F12) gene that causes recurrent edema swelling in patients. Typical symptoms of HAE include severe swelling of the arms, legs, hands, feet, face, tongue and larynx, abdomen, trunk, genitals, nausea, vomiting, abdominal pain, and nonpriuric rash. Elevated levels of bradykinin peptide are observed during HAE attacks or episodes.

In another embodiment, the contact activation pathway-associated disease is prekallikrein deficiency.

In another embodiment, the contact activation pathway-associated disease is malignant essential hypertension.

In another embodiment, the contact activation pathway-associated disease is hypertension.

In another embodiment, the contact activation pathway-associated disease is end stage renal disease.

"Therapeutically effective amount," as used herein, is intended to include the amount of an RNAi agent that, when administered to a patient for treating a subject having HAE and/or contact activation pathway-associated disease, is sufficient to effect treatment of the disease (e.g., by diminishing, ameliorating or maintaining the existing disease or one or more symptoms of disease). The "therapeutically effective amount" may vary depending on the RNAi agent, how the agent is administered, the disease and its severity and the history, age, weight, family history, genetic makeup, stage of pathological processes mediated by contact activation pathway gene expression, the types of preceding or concomitant treatments, if any, and other individual characteristics of the patient to be treated.

"Prophylactically effective amount," as used herein, is intended to include the amount of an RNAi agent that, when administered to a subject who does not yet experience or display symptoms of a contact activation pathway-associated disease, but who may be predisposed or at risk, is sufficient to prevent or ameliorate the disease or one or more symptoms of the disease. Ameliorating the disease includes slowing the course of the disease or reducing the severity of later-developing disease. The "prophylactically effective amount" may vary depending on the RNAi agent, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylacticaly effective amount" also includes an amount of an RNAi agent that produces some desired local or systemic effect at a reasonable benefit/risk ratio applicable to any treatment. RNAi agents employed in the methods of the present invention may be administered in a sufficient amount to produce a reasonable benefit/risk ratio applicable to such treatment.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes), the retina or parts of the retina (e.g., retinal pigment epithelium), the central nervous system or parts of the central nervous system (e.g., ventricles or choroid plexus), or the pancreas or certain cells or parts of the pancreas. In some embodiments, a "sample derived from a subject" refers tocerebrospinal fluid obtained from the subject. In preferred embodiments, a "sample derived from a subject" refers to blood or plasma drawn from the subject. In further embodiments, a "sample derived from a subject" refers to liver tissue (or subcomponents thereof) or retinal tissue (or subcomponents thereof) derived from the subject.

II. iRNAs of the Invention

The present invention provides iRNAs which inhibit the expression of a contact activation pathway gene (i.e., a KLKB1 gene, an F12 gene, or a KNG1 gene). In one embodiment, the iRNA agent includes double stranded ribonucleic acid (dsRNA) molecules for inhibiting the expression of a contact activation pathway gene in a cell, such as a cell within a subject, e.g., a mammal, such as a human having a contact activation pathway-associated disease, e.g., a thrombophilia or hereditary angioedema, or at risk of developing a contact activation pathway-associated disease, e.g., a thrombophilia, or an angioedema attack. The dsRNA includes an antisense strand having a region of complementarity which is complementary to at least a part of an mRNA formed in the expression of a contact activation pathway gene. The region of complementarity is about 30 nucleotides or less in length (e.g., about 30, 29, 28, 27, 26, 25, 24, 23, 22, 21, 20, 19, or 18 nucleotides or less in length). Upon contact with a cell expressing the contact activation pathway gene, the iRNA inhibits the expression of the contact activation pathway gene (e.g., a human, a primate, a non-primate, or a bird contact activation pathway gene) by at least about 10% as assayed by, for example, a PCR or branched DNA (bDNA)-based method, or by a protein-based method, such as by immunofluorescence analysis, using, for example, Western Blotting or flowcytometric techniques.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of a contact activation pathway gene (i.e., a KLKB1 gene, an F12 gene, or a KNG1 gene). The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is between 15 and 30 base pairs in length, e.g., between, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

Similarly, the region of complementarity to the target sequence is between 15 and 30 nucleotides in length, e.g., between 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

In some embodiments, the dsRNA is about 15 to about 20 nucleotides in length, or about 25 to about 30 nucleotides in length. In general, the dsRNA is long enough to serve as a substrate for the Dicer enzyme. For example, it is well-known in the art that dsRNAs longer than about 21-23 nucleotides in length may serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 9 to 36 base pairs, e.g., about 10-36, 11-36, 12-36, 13-36, 14-36, 15-36, 9-35, 10-35, 11-35, 12-35, 13-35, 14-35, 15-35, 9-34, 10-34, 11-34, 12-34, 13-34, 14-34, 15-34, 9-33, 10-33, 11-33, 12-33, 13-33, 14-33, 15-33, 9-32, 10-32, 11-32, 12-32, 13-32, 14-32, 15-32, 9-31, 10-31, 11-31, 12-31, 13-32, 14-31, 15-31, 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target contact activation pathway gene expression is not generated in the target cell by cleavage of a larger dsRNA.

A dsRNA as described herein can further include one or more single-stranded nucleotide overhangs e.g., 1, 2, 3, or 4 nucleotides. dsRNAs having at least one nucleotide overhang can have unexpectedly superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

A dsRNA can be synthesized by standard methods known in the art as further discussed below, e.g., by use of an automated DNA synthesizer, such as are commercially available from, for example, Biosearch, Applied Biosystems, Inc.

iRNA compounds of the invention may be prepared using a two-step procedure. First, the individual strands of the double stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Single-stranded oligonucleotides of the invention can be prepared using solution-phase or solid-phase organic synthesis or both.

In one aspect, a dsRNA of the invention includes at least two nucleotide sequences, a sense sequence and an antisense sequence. The sense strand is selected from the group of sequences provided in any one of Tables 3, 4, 9, 10, 15, 16, 19A, 19B, 19C, 19D, 19E, 19F, 20, 21, 23, 24, 26, and 27, and the corresponding antisense strand of the sense strand is selected from the group of sequences of any one of Tables 3, 4, 9, 10, 15, 16, 19A, 19B, 19C, 19D, 19E, 19F, 20, 21, 23, 24, 26, and 27.

In one embodiment, the sense strand is selected from the group of sequences provided in any one of Tables 3, 4, 19A, and 19B and the corresponding antisense strand of the sense strand is selected from the group of sequences of any one of Tables 3, 4, 19A, and 19B. In this aspect, one of the two sequences is complementary to the other of the two sequences, with one of the sequences being substantially complementary to a sequence of an mRNA generated in the expression of a KLKB1 gene. As such, in this aspect, a dsRNA will include two oligonucleotides, where one oligonucleotide is described as the sense strand in any one of Tables 3, 4, 19A, and 19B and the second oligonucleotide is described as the corresponding antisense strand of the sense strand in any one of Tables 3, 4, 19A, and 19B. In one embodiment, the substantially complementary sequences of the dsRNA are contained on separate oligonucleotides. In another embodiment, the substantially complementary sequences of the dsRNA are contained on a single oligonucleotide.

In one embodiment, the sense strand is selected from the group of sequences provided in any one of any one of Tables 9, 10, 19C, 19D, 20, 21, 23, 24, 26, and 27, and the corresponding antisense strand of the sense strand is selected from the group of sequences of any one of Tables 9, 10, 19C, 19D, 20, 21, 23, 24, 26, and 27. In this aspect, one of the two sequences is complementary to the other of the two sequences, with one of the sequences being substantially complementary to a sequence of an mRNA generated in the expression of an F12 gene. As such, in this aspect, a dsRNA will include two oligonucleotides, where one oligonucleotide is described as the sense strand in any one of Tables 9, 10, 19C, 19D, 20, 21, 23, 24, 26, and 27, and the second oligonucleotide is described as the corresponding antisense strand of the sense strand in any one of Tables 9, 10, 19C, 19D, 20, 21, 23, 24, 26, and 27. In one embodiment, the substantially complementary sequences of the dsRNA are contained on separate oligonucleotides. In another embodiment, the substantially complementary sequences of the dsRNA are contained on a single oligonucleotide.

In one embodiment, the sense strand is selected from the group of sequences provided in any one of Tables 15, 16, 19E, and 19F, and the corresponding antisense strand of the sense strand is selected from the group of sequences of any one of Tables 15, 16, 19E, and 19F. In this aspect, one of the two sequences is complementary to the other of the two sequences, with one of the sequences being substantially complementary to a sequence of an mRNA generated in the expression of a KNG1 gene. As such, in this aspect, a dsRNA will include two oligonucleotides, where one oligonucleotide is described as the sense strand in any one of Tables 15, 16, 19E, and 19F, and the second oligonucleotide is described as the corresponding antisense strand of the sense strand in any one of Tables 15, 16, 19E, and 19F. In one embodiment, the substantially complementary sequences of the dsRNA are contained on separate oligonucleotides. In another embodiment, the substantially complementary sequences of the dsRNA are contained on a single oligonucleotide.

It will be understood that, although some of the sequences in Tables 3, 4, 9, 10, 15, 16, 19A, 19B, 19C, 19D, 19E, 19F, 20, 21, 23, 24, 26, and 27 are described as modified and/or conjugated sequences, the RNA of the iRNA of the invention e.g., a dsRNA of the invention, may comprise any one of the sequences set forth in Tables 3, 4, 9, 10, 15, 16, 19A, 19B, 19C, 19D, 19E, 19F, 20, 21, 23, 24, 26, and 27 that is un-modified, un-conjugated, and/or modified and/or conjugated differently than described therein.

The skilled person is well aware that dsRNAs having a duplex structure of about 20 to about 23 base pairs, e.g., 21, base pairs have been hailed as particularly effective in inducing RNA interference (Elbashir et al., *EMBO* 2001, 20:6877-6888). However, others have found that shorter or longer RNA duplex structures can also be effective (Chu and Rana (2007) *RNA* 14:1714-1719; Kim et al. (2005) *Nat Biotech* 23:222-226). In the embodiments described above, by virtue of the nature of the oligonucleotide sequences provided in any one of Tables 3, 4, 9, 10, 15, 16, 19A, 19B, 19C, 19D, 19E, 19F, 20, 21, 23, 24, 26, and 27, dsRNAs described herein can include at least one strand of a length of minimally 21 nucleotides. It can be reasonably expected that shorter duplexes having one of the sequences of any one of Tables 3, 4, 9, 10, 15, 16, 19A, 19B, 19C, 19D, 19E, 19F, 20, 21, 23, 24, 26, and 27 minus only a few nucleotides on one or both ends can be similarly effective as compared to the dsRNAs described above. Hence, dsRNAs having a sequence of at least 15, 16, 17, 18, 19, 20, or more contiguous nucleotides derived from one of the sequences of any one of Tables 3, 4, 19A, and 19B and differing in their ability to inhibit the expression of a KLKB1 gene by not more than about 5, 10, 15, 20, 25, or 30% inhibition from a dsRNA comprising the full sequence, dsRNAs having a sequence of at least 15, 16, 17, 18, 19, 20, or more contiguous nucleotides derived from one of the sequences of any one of Tables 9, 10, 19C, 19D, 20, and 21, and differing in their ability to inhibit the expression of an F12 gene by not more than about 5, 10, 15, 20, 25, or 30% inhibition from a dsRNA comprising the full sequence, and dsRNAs having a sequence of at least 15, 16, 17, 18, 19, 20, or more contiguous nucleotides derived from one of the sequences of any one of Tables 15, 16, 19E, and 19F, and differing in their ability to inhibit the expression of a KNG1 gene by not more than about 5, 10, 15, 20, 25, or 30% inhibition from a dsRNA comprising the full sequence, are contemplated to be within the scope of the present invention.

In addition, the RNAs provided in any one of Tables 3, 4, 19A, and 19B identify a site(s) in a KLKB1 transcript that is susceptible to RISC-mediated cleavage, the RNAs provided in any one of Tables 9, 10, 19C, 19D, 20, 21, 23, 24, 26, and 27 identify a site(s) in an F12 transcript that is susceptible to RISC-mediated cleavage, and RNAs provided in any one of Tables 15, 16, 19E, and 19F identify a site(s) in a KNG1 transcript that is susceptible to RISC-mediated cleavage. As such, the present invention further features iRNAs that target within one of these sites. As used herein, an iRNA is said to target within a particular site of an RNA transcript if the iRNA promotes cleavage of the transcript anywhere within that particular site. Such an iRNA will generally include at least about 15 contiguous nucleotides from one of the sequences provided in any one of Tables 3, 4, 9, 10, 15, 16, 19A, 19B, 19C, 19D, 19E, 19F, 20, 21, 23, 24, 26, and 27 coupled to additional nucleotide sequences taken from the region contiguous to the selected sequence in the contact activation pathway gene.

While a target sequence is generally about 15-30 nucleotides in length, there is wide variation in the suitability of particular sequences in this range for directing cleavage of any given target RNA. Various software packages and the guidelines set out herein provide guidance for the identification of optimal target sequences for any given gene target, but an empirical approach can also be taken in which a "window" or "mask" of a given size (as a non-limiting example, 21 nucleotides) is literally or figuratively (including, e.g., in silico) placed on the target RNA sequence to identify sequences in the size range that can serve as target sequences. By moving the sequence "window" progressively one nucleotide upstream or downstream of an initial target sequence location, the next potential target sequence can be identified, until the complete set of possible sequences is identified for any given target size selected. This process, coupled with systematic synthesis and testing of the identified sequences (using assays as described herein or as known in the art) to identify those sequences that perform optimally can identify those RNA sequences that, when targeted with an iRNA agent, mediate the best inhibition of target gene expression. Thus, while the sequences identified, for example, in any one of Tables 3, 4, 9, 10, 15, 16, 19A, 19B, 19C, 19D, 19E, 19F, 20, 21, 23, 24, 26, and 27 represent effective target sequences, it is contemplated that further optimization of inhibition efficiency can be achieved by progressively "walking the window" one nucleotide upstream or downstream of the given sequences to identify sequences with equal or better inhibition characteristics.

Further, it is contemplated that for any sequence identified, e.g., in any one of Tables 3, 4, 9, 10, 15, 16, 19A, 19B, 19C, 19D, 19E, 19F, 20, 21, 23, 24, 26, and 27 further optimization could be achieved by systematically either adding or removing nucleotides to generate longer or shorter sequences and testing those sequences generated by walking a window of the longer or shorter size up or down the target RNA from that point. Again, coupling this approach to generating new candidate targets with testing for effectiveness of iRNAs based on those target sequences in an inhibition assay as known in the art and/or as described herein can lead to further improvements in the efficiency of inhibition. Further still, such optimized sequences can be adjusted by, e.g., the introduction of modified nucleotides as described herein or as known in the art, addition or changes in overhang, or other modifications as known in the art and/or discussed herein to further optimize the molecule (e.g., increasing serum stability or circulating half-life, increasing thermal stability, enhancing transmembrane delivery, targeting to a particular location or cell type, increasing interaction with silencing pathway enzymes, increasing release from endosomes) as an expression inhibitor.

An iRNA as described herein can contain one or more mismatches to the target sequence. In one embodiment, an iRNA as described herein contains no more than 3 mismatches. If the antisense strand of the iRNA contains mismatches to a target sequence, it is preferable that the area of mismatch is not located in the center of the region of complementarity. If the antisense strand of the iRNA contains mismatches to the target sequence, it is preferable that the mismatch be restricted to be within the last 5 nucleotides from either the 5'- or 3'-end of the region of complementarity. For example, for a 23 nucleotide iRNA agent the strand which is complementary to a region of a contact activation pathway gene, generally does not contain any mismatch within the central 13 nucleotides. The methods described herein or methods known in the art can be used to determine whether an iRNA containing a mismatch to a target sequence is effective in inhibiting the expression of a contact activation pathway gene. Consideration of the efficacy of iRNAs with mismatches in inhibiting expression of a contact activation pathway gene is important, especially if the particular region of complementarity in a contact activation pathway gene is known to have polymorphic sequence variation within the population.

III. Modified iRNAs of the Invention

In one embodiment, the RNA of the iRNA of the invention e.g., a dsRNA, is un-modified, and does not comprise, e.g., chemical modifications and/or conjugations known in the art and described herein. In another embodiment, the RNA of an iRNA of the invention, e.g., a dsRNA, is chemically modified to enhance stability or other beneficial characteristics. In certain embodiments of the invention, substantially all of the nucleotides of an iRNA of the invention are modified. In other embodiments of the invention, all of the nucleotides of an iRNA of the invention are modified iRNAs of the invention in which "substantially all of the nucleotides are modified" are largely but not wholly modified and can include not more than 5, 4, 3, 2, or 1 unmodified nucleotides. In some embodiments, substantially all of the nucleotides of an iRNA of the invention are modified and the iRNA comprises no more than 8 2'-fluoro modifications (e.g., no more than 7 2'-fluoro modifications, no more than 6 2'-fluoro modifications, no more than 5 2'-fluoro modification, no more than 4 2'-fluoro modifications, no more than 3 2'-fluoro modifications, or no more than 2 2'-fluoro modifications) on the sense strand and no more than 6 2'-fluoro modifications (e.g., no more than 5 2'-fluoro modifications, no more than 4 2'-fluoro modifications, no more than 3 2'-fluoro modifications, or no more than 2 2'-fluoro modifications) on the antisense strand. In other embodiments, all of the nucleotides of an iRNA of the invention are modified and the iRNA comprises no more than 8 2'-fluoro modifications (e.g., no more than 7 2'-fluoro modifications, no more than 6 2'-fluoro modifications, no more than 5 2'-fluoro modification, no more than 4 2'-fluoro modifications, no more than 3 2'-fluoro modifications, or no more than 2 2'-fluoro modifications) on the sense strand and no more than 6 2'-fluoro modifications (e.g., no more than 5 2'-fluoro modifications, no more than 4 2'-fluoro modifications, no more than 3 2'-fluoro modifications, or no more than 2 2'-fluoro modifications) on the antisense strand.

The nucleic acids featured in the invention can be synthesized and/or modified by methods well established in the art, such as those described in "Current protocols in nucleic acid chemistry," Beaucage, S. L. et al. (Edrs.), John Wiley & Sons, Inc., New York, NY, USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; and/or backbone modifications, including modification or replacement of the phosphodiester linkages. Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, the entire contents of each of which are hereby incorporated herein by reference.

In other embodiments, suitable RNA mimetics are contemplated for use in iRNAs, in which both the sugar and the internucleoside linkage, i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., *Science*, 1991, 254, 1497-1500.

Some embodiments featured in the invention include RNAs with phosphorothioate backbones and oligonucleosides with heteroatom backbones, and in particular—$CH_2$—NH—$CH_2$—, —$CH_2$—$N(CH_3)$—O—$CH_2$-[known as a methylene (methylimino) or MMI backbone], —$CH_2$—O—$N(CH_3)$—$CH_2$—, —$CH_2$—$N(CH_3)$—$N(CH_3)$—$CH_2$— and —$N(CH_3)$—$CH_2$—$CH_2$—[wherein the native phosphodiester backbone is represented as —O—P—O—$CH_2$—] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs can also contain one or more substituted sugar moieties. The iRNAs, e.g., dsRNAs, featured herein can include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2)\cdot_nOCH_3$, $O(CH_2)_nNH_2$, $O(CH_2)_nCH_3$, $O(CH_2)_nONH_2$, and $O(CH_2)_nON[(CH_2)_nCH_3)]_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., *Helv. Chim. Acta*, 1995, 78:486-504) i.e., an alkoxy-alkoxy group. Another exemplary modification is 2'-dimethylaminooxyethoxy, i.e., a $O(CH_2)_2ON(CH_3)_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—$N(CH_2)_2$.

Other modifications include 2'-methoxy (2'-$OCH_3$), 2'-aminopropoxy (2'-$OCH_2CH_2CH_2NH_2$) and 2'-fluoro (2'-F). Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

The RNA of an iRNA can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as deoxy-thymine (dT), 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

The RNA of an iRNA can also be modified to include one or more bicyclic sugar moities. A "bicyclic sugar" is a furanosyl ring modified by the bridging of two atoms. A "bicyclic nucleoside" ("BNA") is a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring. Thus, in some embodiments an agent of the invention may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-$CH_2$—O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. Et al., (2007) *Mol Canc Ther* 6(3):833-843; Grunweller, A. et al., (2003) *Nucleic Acids Research* 31(12): 3185-3193). Examples of bicyclic nucleosides for use in the polynucleotides of the invention include without limitation nucleosides comprising a bridge between the 4' and the 2' ribosyl ring atoms. In certain embodiments, the antisense polynucleotide agents of the invention include one or more bicyclic nucleosides comprising a 4' to 2' bridge. Examples of such 4' to 2' bridged bicyclic nucleosides, include but are not limited to 4'-(CH2)-O-2' (LNA); 4'-(CH2)-S-2'; 4'-(CH2)2-O-2' (ENA); 4'-CH(CH3)-O-2' (also referred to as "constrained ethyl" or "cEt") and 4'-CH(CH2OCH3)-O-2' (and analogs thereof; see, e.g., U.S. Pat. No. 7,399,845); 4'-C(CH3)(CH3)-O-2' (and analogs thereof; see e.g., U.S. Pat. No. 8,278,283); 4'-CH2-N(OCH3)-2' (and analogs thereof; see e.g., U.S. Pat. No. 8,278,425); 4'-CH2-O—N (CH3)-2' (see, e.g., U.S. Patent Publication No. 2004/0171570); 4' —CH2-N(R)—O-2', wherein R is H, C1-C12 alkyl, or a protecting group (see, e.g., U.S. Pat. No. 7,427,672); 4'-CH2-C(H)(CH3)-2' (see, e.g., Chattopadhyaya et al., *J. Org. Chem.*, 2009, 74, 118-134); and 4'-CH2-C (=CH2)-2' (and analogs thereof; see, e.g., U.S. Pat. No. 8,278,426). The entire contents of each of the foregoing are hereby incorporated herein by reference.

Additional representative U.S. Patents and US Patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

The RNA of an iRNA can also be modified to include one or more constrained ethyl nucleotides. As used herein, a "constrained ethyl nucleotide" or "cEt" is a locked nucleic acid comprising a bicyclic sugar moiety comprising a 4'-CH ($CH_3$)—O-2' bridge. In one embodiment, a constrained ethyl nucleotide is in the S conformation referred to herein as "S-cEt."

An iRNA of the invention may also include one or more "conformationally restricted nucleotides" ("CRN"). CRN are nucleotide analogs with a linker connecting the C2' and C4' carbons of ribose or the C3 and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US Patent Publication No. 2013/0190383; and PCT publication WO 2013/036868, the entire contents of each of which are hereby incorporated herein by reference.

One or more of the nucleotides of an iRNA of the invention may also include a hydroxymethyl substituted nucleotide. A "hydroxymethyl substituted nucleotide" is an acyclic 2'-3'-seco-nucleotide, also referred to as an "unlocked nucleic acid" ("UNA") modification Representative U.S. publications that teach the preparation of UNA include, but are not limited to, U.S. Pat. No. 8,314,227; and US Patent Publication Nos. 2013/0096289; 2013/0011922; and 2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in PCT Publication No. WO 2011/005861.

Other modifications of the nucleotides of an iRNA of the invention include a 5' phosphate or 5' phosphate mimic, e.g., a 5'-terminal phosphate or phosphate mimic on the antisense strand of an RNAi agent. Suitable phosphate mimics are disclosed in, for example US Patent Publication No. 2012/0157511, the entire contents of which are incorporated herein by reference.

A. Modified iRNAs Comprising Motifs of the Invention

In certain aspects of the invention, the double stranded RNAi agents of the invention include agents with chemical modifications as disclosed, for example, in U.S. Provisional Application No. 61/561,710, filed on Nov. 18, 2011, or in PCT/US2012/065691, filed on Nov. 16, 2012, the entire contents of each of which are incorporated herein by reference. As shown herein and in Provisional Application No. 61/561,710 or PCT Application No. PCT/US2012/065691, a superior result may be obtained by introducing one or more motifs of three identical modifications on three consecutive nucleotides into a sense strand and/or antisense strand of an RNAi agent, particularly at or near the cleavage site. In some embodiments, the sense strand and antisense strand of the RNAi agent may otherwise be completely modified. The introduction of these motifs interrupts the modification pattern, if present, of the sense and/or antisense strand. The RNAi agent may be optionally conjugated with a GalNAc derivative ligand, for instance on the sense strand. The resulting RNAi agents present superior gene silencing activity.

More specifically, it has been surprisingly discovered that when the sense strand and antisense strand of the double stranded RNAi agent are completely modified to have one or more motifs of three identical modifications on three consecutive nucleotides at or near the cleavage site of at least one strand of an RNAi agent, the gene silencing acitivity of the RNAi agent was superiorly enhanced.

Accordingly, the invention provides double stranded RNAi agents capable of inhibiting the expression of a target gene (i.e., a contact activation pathway gene, i.e., a KLKB1 gene, an F12 gene, or a KNG1 gene) in vivo. The RNAi agent comprises a sense strand and an antisense strand. Each strand of the RNAi agent may range from 12-30 nucleotides in length. For example, each strand may be between 14-30 nucleotides in length, 17-30 nucleotides in length, 25-30 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex double stranded RNA ("dsRNA"), also referred to herein as an "RNAi agent." The duplex region of an RNAi agent may be 12-30 nucleotide pairs in length. For example, the duplex region can be between 14-30 nucleotide pairs in length, 17-30 nucleotide pairs in length, 27-30 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 15, 16, 17, 18, 19, 20, 21, 22, 23, 24, 25, 26, and 27 nucleotides in length.

In one embodiment, the RNAi agent may contain one or more overhang regions and/or capping groups at the 3'-end, 5'-end, or both ends of one or both strands. The overhang can be 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In one embodiment, the nucleotides in the overhang region of the RNAi agent can each independently be a modified or unmodified nucleotide including, but no limited to 2'-sugar modified, such as, 2-F, 2'-Omethyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof. For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand or both strands of the RNAi agent may be phosphorylated. In some embodiments, the overhang region(s) contains two nucleotides having a phosphorothioate between the two nucleotides, where the two nucleotides can be the same or different. In one embodiment, the overhang is present at the 3'-end of the sense strand, antisense strand, or both strands. In one embodiment, this 3'-overhang is present in the antisense strand. In one embodiment, this 3'-overhang is present in the sense strand.

The RNAi agent may contain only a single overhang, which can strengthen the interference activity of the RNAi, without affecting its overall stability. For example, the single-stranded overhang may be located at the 3'-terminal end of the sense strand or, alternatively, at the 3'-terminal end of the antisense strand. The RNAi may also have a blunt end, located at the 5'-end of the antisense strand (or the 3'-end of the sense strand) or vice versa. Generally, the antisense strand of the RNAi has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In one embodiment, the RNAi agent is a double ended bluntmer of 19 nucleotides in length, wherein the sense strand contains at least one motif of three 2'-F modifications on three consecutive nucleotides at positions 7, 8, 9 from the 5'end. The antisense strand contains at least one motif of three 2'-O-methyl modifications on three consecutive nucleotides at positions 11, 12, 13 from the 5'end.

In another embodiment, the RNAi agent is a double ended bluntmer of 20 nucleotides in length, wherein the sense strand contains at least one motif of three 2'-F modifications on three consecutive nucleotides at positions 8, 9, 10 from the 5'end. The antisense strand contains at least one motif of three 2'-O-methyl modifications on three consecutive nucleotides at positions 11, 12, 13 from the 5'end.

In yet another embodiment, the RNAi agent is a double ended bluntmer of 21 nucleotides in length, wherein the sense strand contains at least one motif of three 2'-F modifications on three consecutive nucleotides at positions 9, 10, 11 from the 5'end. The antisense strand contains at least one motif of three 2'-O-methyl modifications on three consecutive nucleotides at positions 11, 12, 13 from the 5'end.

In one embodiment, the RNAi agent comprises a 21 nucleotide sense strand and a 23 nucleotide antisense strand, wherein the sense strand contains at least one motif of three 2'-F modifications on three consecutive nucleotides at positions 9, 10, 11 from the 5'end; the antisense strand contains at least one motif of three 2'-O-methyl modifications on three consecutive nucleotides at positions 11, 12, 13 from the 5'end, wherein one end of the RNAi agent is blunt, while the other end comprises a 2 nucleotide overhang. Preferably, the 2 nucleotide overhang is at the 3'-end of the antisense strand.

When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In one embodiment, every nucleotide in the sense strand and the antisense strand of the RNAi agent, including the nucleotides that are part of the motifs are modified nucleotides. In one embodiment each residue is independently modified with a 2'-O-methyl or 3'-fluoro, e.g., in an alternating motif. Optionally, the RNAi agent further comprises a ligand (preferably GalNAc3).

In one embodiment, the RNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3'terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site.

The antisense strand contains at least one motif of three 2'-O-methyl modifications on three consecutive nucleotides at or near the cleavage site.

In one embodiment, the RNAi agent comprises sense and antisense strands, wherein the RNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1-4 nucleotides longer at its 3' end than the first strand, wherein the duplex region which is at least 25 nucleotides in length, and the second strand is sufficiently complementary to a target mRNA along at least 19 nucleotide of the second strand length to reduce target gene expression when the RNAi agent is introduced into a mammalian cell, and wherein dicer cleavage of the RNAi agent preferentially results in an siRNA comprising the 3' end of the second strand, thereby reducing expression of the target gene in the mammal. Optionally, the RNAi agent further comprises a ligand.

In one embodiment, the sense strand of the RNAi agent contains at least one motif of three identical modifications on three consecutive nucleotides, where one of the motifs occurs at the cleavage site in the sense strand.

In one embodiment, the antisense strand of the RNAi agent can also contain at least one motif of three identical modifications on three consecutive nucleotides, where one of the motifs occurs at or near the cleavage site in the antisense strand For an RNAi agent having a duplex region of 17-23 nucleotide in length, the cleavage site of the antisense strand is typically around the 10, 11 and 12 positions from the 5'-end. Thus the motifs of three identical modifications may occur at the 9, 10, 11 positions; 10, 11, 12 positions; 11, 12, 13 positions; 12, 13, 14 positions; or 13, 14, 15 positions of the antisense strand, the count starting from the $1^{st}$ nucleotide from the 5'-end of the antisense strand, or, the count starting from the $1^{st}$ paired nucleotide within the duplex region from the 5'-end of the antisense strand. The cleavage site in the antisense strand may also change according to the length of the duplex region of the RNAi from the 5'-end.

The sense strand of the RNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In one embodiment, the sense strand of the RNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other then the chemistry of the motifs are distinct from each other and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the RNAi agent may contain more than one motifs of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In one embodiment, the wing modification on the sense strand or antisense strand of the RNAi agent typically does not include the first one or two terminal nucleotides at the 3'-end, 5'-end or both ends of the strand.

In another embodiment, the wing modification on the sense strand or antisense strand of the RNAi agent typically does not include the first one or two paired nucleotides within the duplex region at the 3'-end, 5'-end or both ends of the strand.

When the sense strand and the antisense strand of the RNAi agent each contain at least one wing modification, the wing modifications may fall on the same end of the duplex region, and have an overlap of one, two or three nucleotides.

When the sense strand and the antisense strand of the RNAi agent each contain at least two wing modifications, the sense strand and the antisense strand can be so aligned that two modifications each from one strand fall on one end of the duplex region, having an overlap of one, two or three nucleotides; two modifications each from one strand fall on the other end of the duplex region, having an overlap of one, two or three nucleotides; two modifications one strand fall on each side of the lead motif, having an overlap of one, two or three nucleotides in the duplex region.

In one embodiment, every nucleotide in the sense strand and antisense strand of the RNAi agent, including the nucleotides that are part of the motifs, may be modified. Each nucleotide may be modified with the same or different modification which can include one or more alteration of one or both of the non-linking phosphate oxygens and/or of one or more of the linking phosphate oxygens; alteration of a constituent of the ribose sugar, e.g., of the 2' hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases the modification will occur at all of the subject positions in the nucleic acid but in many cases it will not. By way of example, a modification may only occur at a 3' or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of a RNA or may only occur in a single strand region of a RNA. For example, a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5' end or ends can be phosphorylated.

It may be possible, e.g., to enhance stability, to include particular bases in overhangs, or to include modified nucleotides or nucleotide surrogates, in single strand overhangs, e.g., in a 5' or 3' overhang, or in both. For example, it can be desirable to include purine nucleotides in overhangs. In some embodiments all or some of the bases in a 3' or 5' overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In one embodiment, each residue of the sense strand and antisense strand is independently modified with LNA, CRN, cET, UNA, HNA, CeNA, 2'-methoxyethyl, 2'-O-methyl, 2'-O-allyl, 2'-C-allyl, 2'-deoxy, 2'-hydroxyl, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-O-methyl or 2'-fluoro modifications, or others.

In one embodiment, the $N_a$ and/or $N_b$ comprise modifications of an alternating pattern. The term "alternating motif" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AAB-BAABBAABB . . . ," "AABAABAABAAB . . . ," "AAA-BAAABAAAB . . . ," "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABA-BAB . . . ", "ACACAC . . . " "BDBDBD . . . " or "CDCDCD . . . ," etc.

In one embodiment, the RNAi agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5'-3' of the strand and the alternating motif in the antisense strand may start with "BABABA" from 5'-3' of the strand within the duplex region. As another example, the alternating motif in the sense strand may start with "AABBAABB" from 5'-3' of the strand and the alternating motif in the antisenese strand may start with "BBAABBAA" from 5'-3' of the strand within the duplex region, so that there is a complete or partial shift of the modification patterns between the sense strand and the antisense strand.

In one embodiment, the RNAi agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification.

The introduction of one or more motifs of three identical modifications on three consecutive nucleotides to the sense strand and/or antisense strand interrupts the initial modification pattern present in the sense strand and/or antisense strand. This interruption of the modification pattern of the sense and/or antisense strand by introducing one or more motifs of three identical modifications on three consecutive nucleotides to the sense and/or antisense strand surprisingly enhances the gene silencing activity to the target gene.

In one embodiment, when the motif of three identical modifications on three consecutive nucleotides is introduced to any of the strands, the modification of the nucleotide next to the motif is a different modification than the modification of the motif. For example, the portion of the sequence containing the motif is " . . . NaYYYNb . . . ," where "Y" represents the modification of the motif of three identical modifications on three consecutive nucleotide, and "$N_a$" and "$N_b$" represent a modification to the nucleotide next to the motif "YYY" that is different than the modification of Y, and where $N_a$ and $N_b$ can be the same or different modifications. Alternatively, $N_a$ and/or $N_b$ may be present or absent when there is a wing modification present.

The RNAi agent may further comprise at least one phosphorothioate or methylphosphonate internucleotide linkage. The phosphorothioate or methylphosphonate internucleotide linkage modification may occur on any nucleotide of the sense strand or antisense strand or both strands in any position of the strand. For instance, the internucleotide linkage modification may occur on every nucleotide on the sense strand and/or antisense strand; each internucleotide linkage modification may occur in an alternating pattern on the sense strand and/or antisense strand; or the sense strand or antisense strand may contain both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand. In one embodiment, a double-stranded RNAi agent comprises 6-8 phosphorothioate internucleotide linkages. In one embodiment, the antisense strand comprises two phosphorothioate internucleotide linkages at the 5'-terminus and two phosphorothioate internucleotide linkages at the 3'-terminus, and the sense strand comprises at least two phosphorothioate internucleotide linkages at either the 5'-terminus or the 3'-terminus.

In one embodiment, the RNAi comprises a phosphorothioate or methylphosphonate internucleotide linkage modification in the overhang region. For example, the overhang region may contain two nucleotides having a phosphorothioate or methylphosphonate internucleotide linkage between the two nucleotides. Internucleotide linkage modifications also may be made to link the overhang nucleotides with the terminal paired nucleotides within the duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. These terminal three nucleotides may be at the 3'-end of the antisense strand, the 3'-end of the sense strand, the 5'-end of the antisense strand, and/or the 5'end of the antisense strand.

In one embodiment, the 2 nucleotide overhang is at the 3'-end of the antisense strand, and there are two phosphorothioate internucleotide linkages between the terminal three nucleotides, wherein two of the three nucleotides are the overhang nucleotides, and the third nucleotide is a paired nucleotide next to the overhang nucleotide. Optionally, the RNAi agent may additionally have two phosphorothioate internucleotide linkages between the terminal three nucleotides at both the 5'-end of the sense strand and at the 5'-end of the antisense strand.

In one embodiment, the RNAi agent comprises mismatch (es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In one embodiment, the RNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In one embodiment, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

In another embodiment, the nucleotide at the 3'-end of the sense strand is deoxy-thymine (dT). In another embodiment, the nucleotide at the 3'-end of the antisense strand is deoxy-thymine (dT). In one embodiment, there is a short sequence of deoxy-thymine nucleotides, for example, two dT nucleotides on the 3'-end of the sense and/or antisense strand.

In one embodiment, the sense strand sequence may be represented by formula (I):

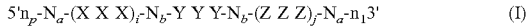
$$5'n_p\text{-}N_a\text{-}(X\,X\,X)_i\text{-}N_b\text{-}Y\,Y\,Y\text{-}N_b\text{-}(Z\,Z\,Z)_j\text{-}N_a\text{-}n_q3' \quad (I)$$

wherein:

i and j are each independently 0 or 1;

p and q are each independently 0-6;

each $N_a$ independently represents an oligonucleotide sequence comprising 0-25 modified nucleotides, each sequence comprising at least two differently modified nucleotides;

each $N_b$ independently represents an oligonucleotide sequence comprising 0-10 modified nucleotides;

each $n_p$ and $n_q$ independently represent an overhang nucleotide;

wherein $N_b$ and Y do not have the same modification; and XXX, YYY and ZZZ each independently represent one motif of three identical modifications on three consecutive nucleotides. Preferably YYY is all 2'-F modified nucleotides.

In one embodiment, the $N_a$ and/or $N_b$ comprise modifications of alternating pattern.

In one embodiment, the YYY motif occurs at or near the cleavage site of the sense strand. For example, when the RNAi agent has a duplex region of 17-23 nucleotides in length, the YYY motif can occur at or the vicinity of the cleavage site (e.g.: can occur at positions 6, 7, 8, 7, 8, 9, 8, 9, 10, 9, 10, 11, 10, 11, 12 or 11, 12, 13) of—the sense strand, the count starting from the 1$^{st}$ nucleotide, from the 5'-end; or optionally, the count starting at the 1$^{st}$ paired nucleotide within the duplex region, from the 5'-end.

In one embodiment, i is 1 and j is 0, or i is 0 and j is 1, or both i and j are 1. The sense strand can therefore be represented by the following formulas:

$$5'n_p\text{-}N_a\text{-}YYY\text{-}N_b\text{-}ZZZ\text{-}N_a\text{-}n_q3' \quad (Ib);$$

$$5'n_p\text{-}N_a\text{-}XXX\text{-}N_b\text{-}YYY\text{-}N_a\text{-}n_q3' \quad (Ic); \text{ or}$$

$$5'n_p\text{-}N_a\text{-}XXX\text{-}N_b\text{-}YYY\text{-}N_b\text{-}ZZZ\text{-}N_a\text{-}n_q3' \quad (Id).$$

When the sense strand is represented by formula (Ib), $N_b$ represents an oligonucleotide sequence comprising 0-10, 0-7, 0-5, 0-4, 0-2 or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2 or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2 or 0 modified nucleotides. Preferably, $N_b$ is 0, 1, 2, 3, 4, 5 or 6 Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

$$5'n_p\text{-}N_a\text{-}YYY\text{-}N_a\text{-}n_q3' \quad (Ia).$$

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

$$5'n_q'\text{-}N_a'\text{-}(Z'Z'Z')_k\text{-}Y'Y'Y'\text{-}N_b'\text{-}(X'X'X')_l\text{-}N_a'\text{-}n_p'3' \quad (II)$$

wherein:

k and l are each independently 0 or 1;

p' and q' are each independently 0-6;

each $N_a'$ independently represents an oligonucleotide sequence comprising 0-25 modified nucleotides, each sequence comprising at least two differently modified nucleotides;

each $N_b'$ independently represents an oligonucleotide sequence comprising 0-10 modified nucleotides;

each $n_p'$ and $n_q'$ independently represent an overhang nucleotide;

wherein $N_b'$ and Y' do not have the same modification; and X'X'X', Y'Y'Y' and Z'Z'Z' each independently represent one motif of three identical modifications on three consecutive nucleotides.

In one embodiment, the $N_a'$ and/or $N_b'$ comprise modifications of alternating pattern.

The Y'Y'Y' motif occurs at or near the cleavage site of the antisense strand. For example, when the RNAi agent has a duplex region of 17-23 nucleotide in length, the Y'Y'Y' motif can occur at positions 9, 10, 11; 10, 11, 12; 11, 12, 13; 12, 13, 14; or 13, 14, 15 of the antisense strand, with the count starting from the 1$^{st}$ nucleotide, from the 5'-end; or optionally, the count starting at the 1$^{st}$ paired nucleotide within the duplex region, from the 5'-end. Preferably, the Y'Y'Y' motif occurs at positions 11, 12, 13.

In one embodiment, Y'Y'Y' motif is all 2'-OMe modified nucleotides.

In one embodiment, k is 1 and l is 0, or k is 0 and l is 1, or both k and l are 1.

The antisense strand can therefore be represented by the following formulas:

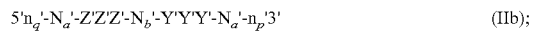
$$5'n_q'\text{-}N_a'\text{-}Z'Z'Z'\text{-}N_b'\text{-}Y'Y'Y'\text{-}N_a'\text{-}n_p'3' \quad (IIb);$$

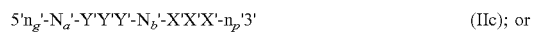
$$5'n_q'\text{-}N_a'\text{-}Y'Y'Y'\text{-}N_b'\text{-}X'X'X'\text{-}n_p'3' \quad (IIc); \text{ or}$$

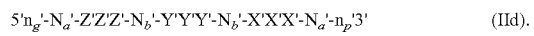
$$5'n_q'\text{-}N_a'\text{-}Z'Z'Z'\text{-}N_b'\text{-}Y'Y'Y'\text{-}N_b'\text{-}X'X'X'\text{-}N_a'\text{-}n_p'3' \quad (IId).$$

When the antisense strand is represented by formula (IIb), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides. Preferably, $N_b$ is 0, 1, 2, 3, 4, 5 or 6.

In other embodiments, k is 0 and 1 is 0 and the antisense strand may be represented by the formula:

$$5'n_p'\text{-}Y'Y'Y'\text{-}N_a'\text{-}n_q'3' \quad (Ia).$$

When the antisense strand is represented as formula (IIa), each $N_a'$ independently represents an oligonucleotide sequence comprising 2-20, 2-15, or 2-10 modified nucleotides. Each of X', Y' and Z' may be the same or different from each other.

Each nucleotide of the sense strand and antisense strand may be independently modified with LNA, CRN, UNA, cEt, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y' and Z', in particular, may represent a 2'-O-methyl modification or a 2'-fluoro modification.

In one embodiment, the sense strand of the RNAi agent may contain YYY motif occurring at 9, 10 and 11 positions of the strand when the duplex region is 21 nt, the count starting from the 1$^{st}$ nucleotide from the 5'-end, or optionally, the count starting at the 1$^{st}$ paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In one embodiment the antisense strand may contain Y'Y'Y' motif occurring at positions 11, 12, 13 of the strand, the count starting from the 1$^{st}$ nucleotide from the 5'-end, or optionally, the count starting at the 1$^{st}$ paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification. The sense strand represented by any one of the above formulas (Ia), (Ib), (Ic), and (Id) forms a duplex with a antisense strand being represented by any one of formulas (IIa), (IIb), (IIc), and (IId), respectively.

Accordingly, the RNAi agents for use in the methods of the invention may comprise a sense strand and an antisense strand, each strand having 14 to 30 nucleotides, the RNAi duplex represented by formula (III):

sense: 5'$n_p$-$N_a$-(X X X)$_i$-$N_b$-Y Y Y-$N_b$-(ZZZ)$_j$-$N_a$-$n_q$3' antisense: 3'$n_p$'-$N_a$-(X'X'X')$_k$-$N_b$-Y'Y'Y'-$N_b$-(Z'Z'Z')$_l$-$N_a$-$n_q$'5' (III)

wherein:
i, j, k, and l are each independently 0 or 1;
p, p', q, and q' are each independently 0-6;
each $N_a$ and $N_a$' independently represents an oligonucleotide sequence comprising 0-25 modified nucleotides, each sequence comprising at least two differently modified nucleotides; each $N_b$ and $N_b$ independently represents an oligonucleotide sequence comprising 0-10 modified nucleotides;
wherein each $n_p$', $n_p$, $n_q$', and $n_q$, each of which may or may not be present, independently represents an overhang nucleotide; and
XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming a RNAi duplex include the formulas below:

5'$n_p$-$N_a$-Y Y Y-$N_a$-$n_q$3'3'$n_p$-$N_a$-Y'Y'Y'-$N_a$'$n_q$'5' (IIIa)

5'$n_p$-$N_a$-Y Y Y-$N_b$-ZZZ-$N_a$-$n_q$3'3'$n_p$-$N_a$-Y'Y'Y'-$N_b$-Z'Z'Z'-$N_a$$n_q$'5' (IIIb)

5'$n_p$-$N_a$-XXX-$N_b$-Y Y Y-$N_a$-$n_q$3'3'$n_p$-$N_a$-X'X'X'-$N_b$-Y'Y'Y'-$N_a$-$n_q$'5' (IIIc)

5'$n_p$-$N_a$-X X X-$N_b$-Y Y Y-$N_b$-ZZZ-$N_a$-$n_q$3'3'$n_p$-$N_a$-X'X'X'-$N_b$-Y'Y'Y'-$N_b$-Z'Z'Z'-$N_a$-$n_q$'5' (IIId)

When the RNAi agent is represented by formula (IIIa), each $N_a$ independently represents an oligonucleotide sequence comprising 2-20, 2-15, or 2-10 modified nucleotides.

When the RNAi agent is represented by formula (IIIb), each $N_b$ independently represents an oligonucleotide sequence comprising 1-10, 1-7, 1-5 or 1-4 modified nucleotides. Each $N_a$ independently represents an oligonucleotide sequence comprising 2-20, 2-15, or 2-10 modified nucleotides.

When the RNAi agent is represented as formula (IIIc), each $N_b$, $N_b$' independently represents an oligonucleotide sequence comprising 0-10, 0-7, 0-10, 0-7, 0-5, 0-4, 0-2 or 0 modified nucleotides. Each $N_a$ independently represents an oligonucleotide sequence comprising 2-20, 2-15, or 2-10 modified nucleotides.

When the RNAi agent is represented as formula (IIId), each $N_b$, $N_b$' independently represents an oligonucleotide sequence comprising 0-10, 0-7, 0-10, 0-7, 0-5, 0-4, 0-2 or 0 modified nucleotides. Each $N_a$, $N_a$' independently represents an oligonucleotide sequence comprising 2-20, 2-15, or 2-10 modified nucleotides. Each of $N_a$, $N_a$', $N_b$ and $N_b$ independently comprises modifications of alternating pattern.

Each of X, Y and Z in formulas (III), (IIIa), (IIIb), (IIIc), and (IIId) may be the same or different from each other.

When the RNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the RNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the RNAi agent is represented as formula (IIIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In one embodiment, the modification on the Y nucleotide is different than the modification on the Y' nucleotide, the modification on the Z nucleotide is different than the modification on the Z' nucleotide, and/or the modification on the X nucleotide is different than the modification on the X' nucleotide.

In one embodiment, when the RNAi agent is represented by formula (IIId), the $N_a$ modifications are 2'-O-methyl or 2'-fluoro modifications. In another embodiment, when the RNAi agent is represented by formula (IIId), the $N_a$ modifications are 2'-O-methyl or 2'-fluoro modifications and $n_p$'>0 and at least one $n_p$' is linked to a neighboring nucleotide a via phosphorothioate linkage. In yet another embodiment, when the RNAi agent is represented by formula (IIId), the $N_a$ modifications are 2'-O-methyl or 2'-fluoro modifications, $n_p$'>0 and at least one $n_p$' is linked to a neighboring nucleotide via phosphorothioate linkage, and the sense strand is conjugated to one or more GalNAc derivatives attached through a bivalent or trivalent branched linker (described below). In another embodiment, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In one embodiment, when the RNAi agent is represented by formula (IIIa), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In one embodiment, the RNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, the RNAi agent is a multimer containing three, four, five, six or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two RNAi agents represented by formula (III), (IIIa), (IIIb), (IIIc), and (IIId) are linked to each other at the 5' end, and one or both of the 3' ends and are optionally conjugated to a ligand. Each of the agents can target the same gene or two different genes; or each of the agents can target same gene at two different target sites.

Various publications describe multimeric RNAi agents that can be used in the methods of the invention. Such publications include WO2007/091269, U.S. Pat. No. 7,858,769, WO2010/141511, WO2007/117686, WO2009/014887 and WO2011/031520 the entire contents of each of which are hereby incorporated herein by reference.

As described in more detail below, the RNAi agent that contains conjugations of one or more carbohydrate moieties to a RNAi agent can optimize one or more properties of the RNAi agent. In many cases, the carbohydrate moiety will be attached to a modified subunit of the RNAi agent. For example, the ribose sugar of one or more ribonucleotide subunits of a dsRNA agent can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The RNAi agents may be conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and decalin; preferably, the acyclic group is selected from serinol backbone or diethanolamine backbone.

In certain specific embodiments, the RNAi agent for use in the methods of the invention is an agent selected from the group of agents listed in any one of Tables 3, 4, 9, 10, 15, 16, 19A, 19B, 19C, 19D, 19E, 19F, 20, 21, 23, 24, 26, and 27. In one embodiment, the agent is any one of the agents listed in any one of Tables 9, 10, 19C, 19D, 20, 21, 23, 24, 26, and 27. These agents may further comprise a ligand.

IV. iRNAs Conjugated to Ligands

Another modification of the RNA of an iRNA of the invention involves chemically linking to the RNA one or more ligands, moieties or conjugates that enhance the activity, cellular distribution or cellular uptake of the iRNA. Such moieties include but are not limited to lipid moieties such as a cholesterol moiety (Letsinger et al., *Proc. Natl. Acid. Sci. USA*, 1989, 86: 6553-6556), cholic acid (Manoharan et al., *Biorg. Med. Chem. Let.*, 1994, 4:1053-1060), a thioether, e.g., beryl-S-tritylthiol (Manoharan et al., *Ann. N.Y. Acad. Sci.*, 1992, 660:306-309; Manoharan et al., *Biorg. Med. Chem. Let.*, 1993, 3:2765-2770), a thiocholesterol (Oberhauser et al., *Nucl. Acids Res.*, 1992, 20:533-538), an aliphatic chain, e.g., dodecandiol or undecyl residues (Saison-Behmoaras et al., *EMBO J*, 1991, 10:1111-1118; Kabanov et al., *FEBS Lett.*, 1990, 259:327-330; Svinarchuk et al., *Biochimie*, 1993, 75:49-54), a phospholipid, e.g., di-hexadecyl-rac-glycerol or triethyl-ammonium 1,2-di-O-hexadecyl-rac-glycero-3-phosphonate (Manoharan et al., *Tetrahedron Lett.*, 1995, 36:3651-3654; Shea et al., *Nucl. Acids Res.*, 1990, 18:3777-3783), a polyamine or a polyethylene glycol chain (Manoharan et al., *Nucleosides & Nucleotides*, 1995, 14:969-973), or adamantane acetic acid (Manoharan et al., *Tetrahedron Lett.*, 1995, 36:3651-3654), a palmityl moiety (Mishra et al., *Biochim. Biophys. Acta*, 1995, 1264:229-237), or an octadecylamine or hexylaminocarbonyloxycholesterol moiety (Crooke et al., *J. Pharmacol. Exp. Ther.*, 1996, 277:923-937).

In one embodiment, a ligand alters the distribution, targeting or lifetime of an iRNA agent into which it is incorporated. In preferred embodiments a ligand provides an enhanced affinity for a selected target, e.g., molecule, cell or cell type, compartment, e.g., a cellular or organ compartment, tissue, organ or region of the body, as, e.g., compared to a species absent such a ligand. Preferred ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylgalactosamine, or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucoseamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucoseamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated oligonucleotides of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems (Foster City, Calif.). Any other means for such synthesis known in the art may additionally or alternatively be employed. It is also known to use similar techniques to prepare other oligonucleotides, such as the phosphorothioates and alkylated derivatives.

In the ligand-conjugated oligonucleotides and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates

In one embodiment, the ligand or conjugate is a lipid or lipid-based molecule. Such a lipid or lipid-based molecule preferably binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, and/or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In a preferred embodiment, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In another preferred embodiment, the lipid based ligand binds HSA weakly or not at all, such that the conjugate will be preferably distributed to the kidney. Other moieties that target to kidney cells can also be used in place of or in addition to the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as liver cells. Also included are HSA and low density lipoprotein (LDL).

B. Cell Permeation Agents

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 26). An RFGF analogue (e.g., amino acid sequence AALLPVL-LAAP (SEQ ID NO: 27) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 28) and the *Drosophila* Antennapedia protein (RQIKIWFQNRRMKWKK (SEQ ID NO: 29) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidiomimemtics may include D-amino acids, as well as synthetic RGD mimics. In addition to RGD, one can use other moieties that target the integrin ligand. Preferred conjugates of this ligand target PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

C. Carbohydrate Conjugates

In some embodiments of the compositions and methods of the invention, an iRNA oligonucleotide further comprises a carbohydrate. The carbohydrate conjugated iRNA are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri- and oligosaccharides containing from about 4, 5, 6, 7, 8, or 9 monosaccharide units), and polysaccharides such as starches, glycogen, cellulose and polysaccharide gums. Specific monosaccharides include HBV and above (e.g., HBV, C6, C7, or C8) sugars; di- and trisaccharides include sugars having two or three monosaccharide units (e.g., HBV, C6, C7, or C8).

In one embodiment, a carbohydrate conjugate for use in the compositions and methods of the invention is a monosaccharide. In another embodiment, a carbohydrate conjugate for use in the compositions and methods of the invention is selected from the group consisting of:

Formula II

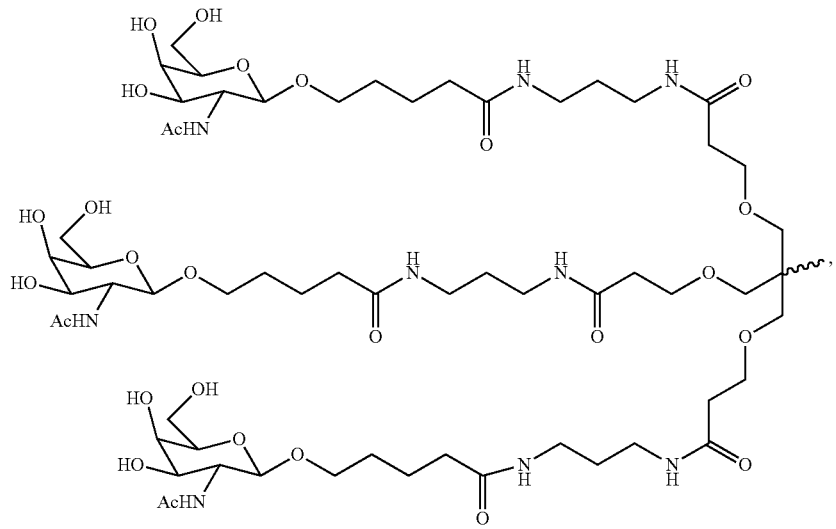

Formula III

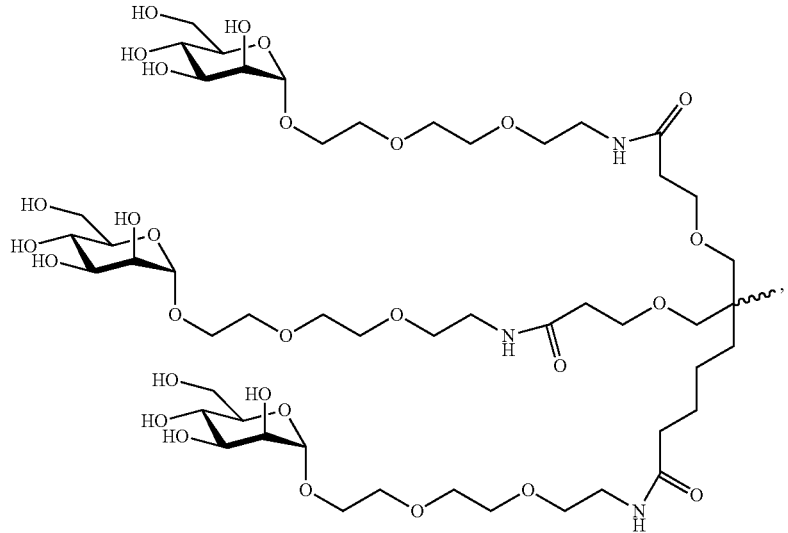

Formula IV

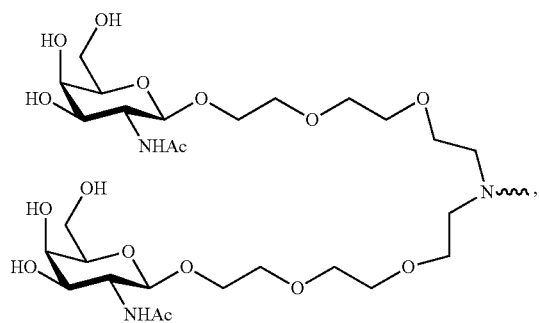

Formula V

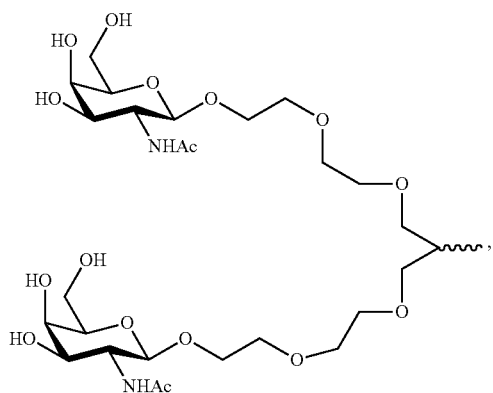

Formula VI
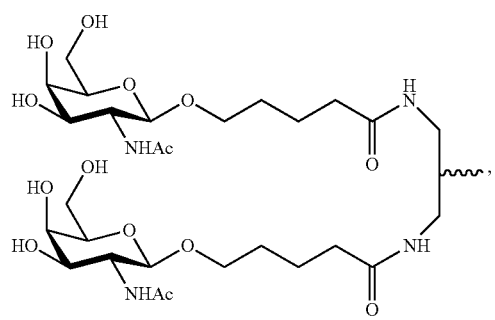
Formula VII
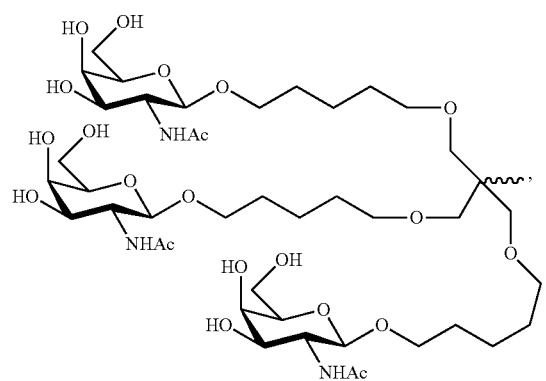
Formula VIII
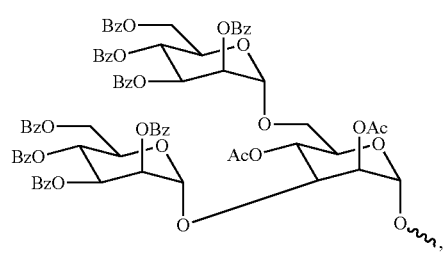
Formula IX
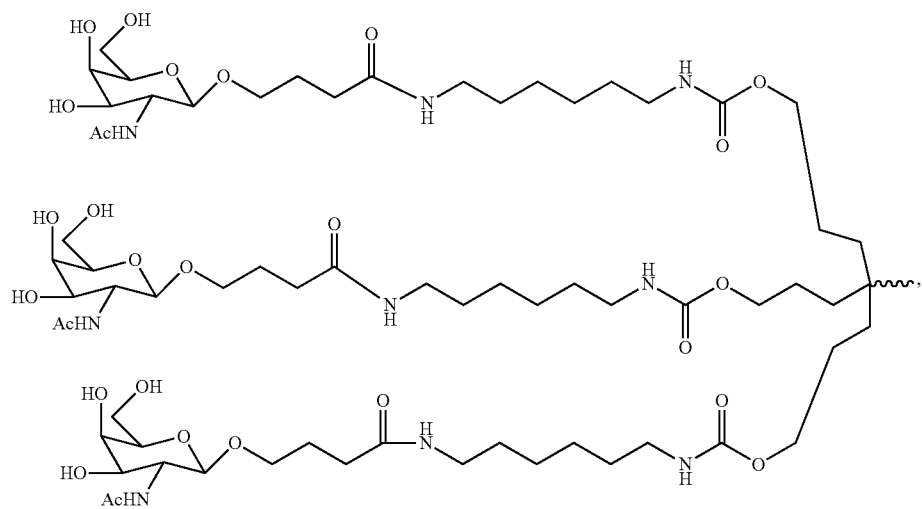
Formula X
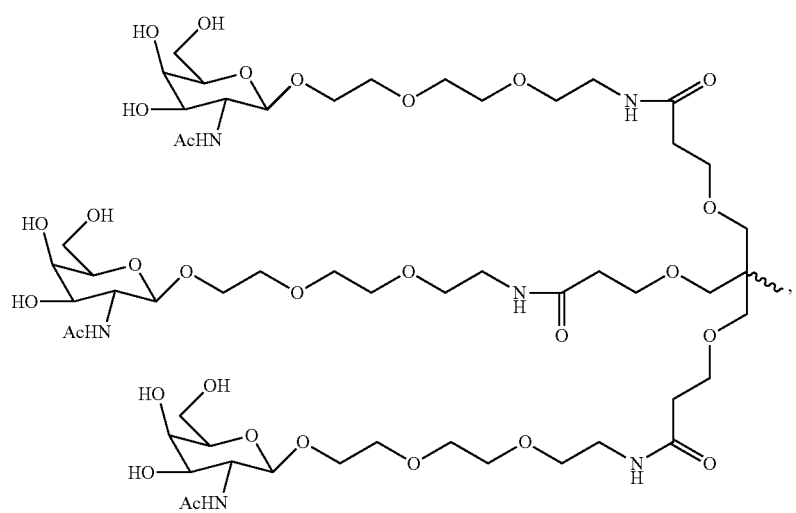

-continued
Formula XI
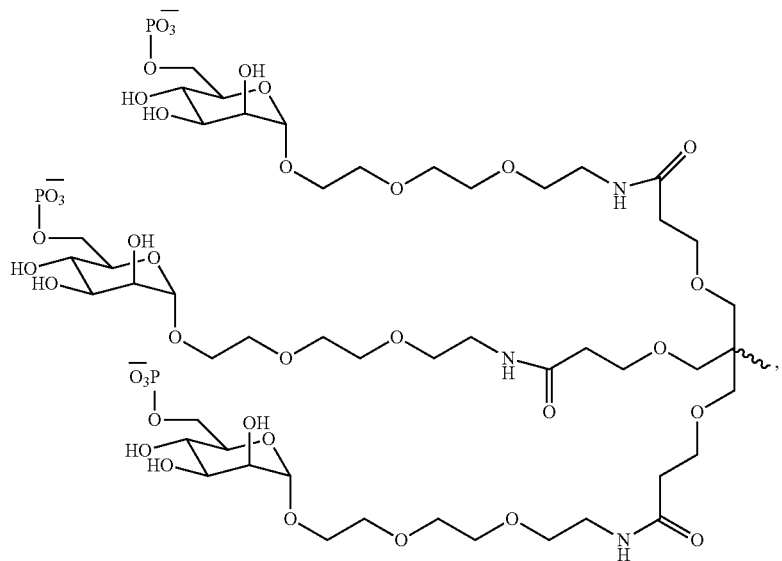
Formula XII
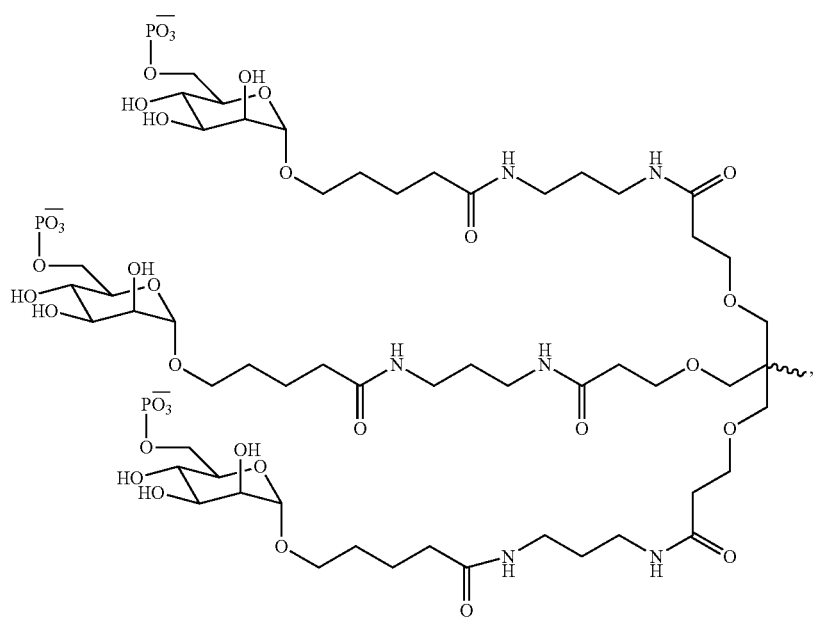
Formula XIII
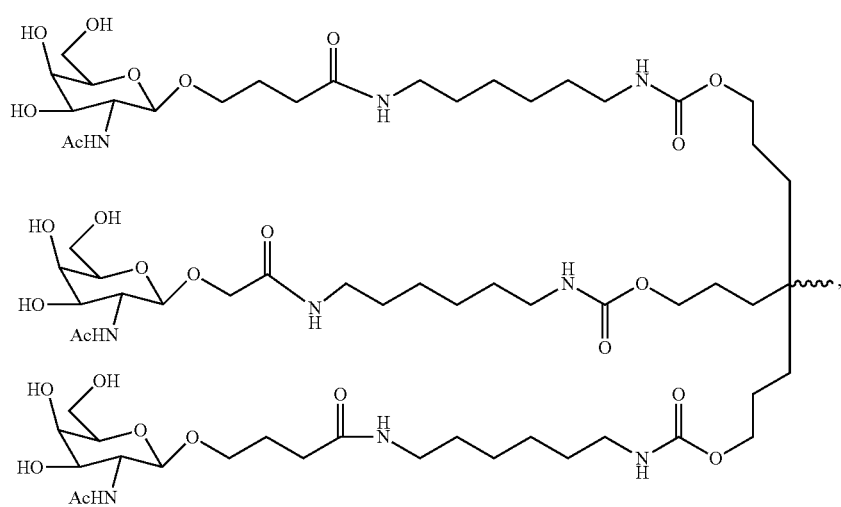

-continued
Formula XIV
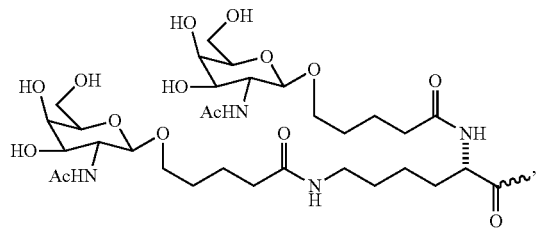
Formula XV
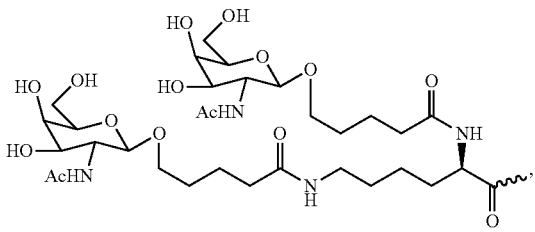
Formula XVI
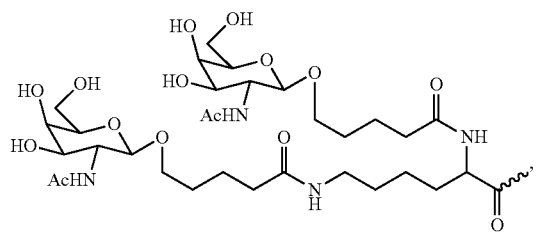
Formula XVII
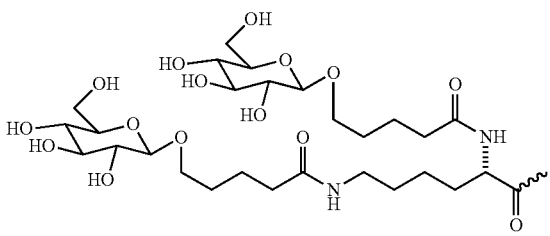
Formula XVIII
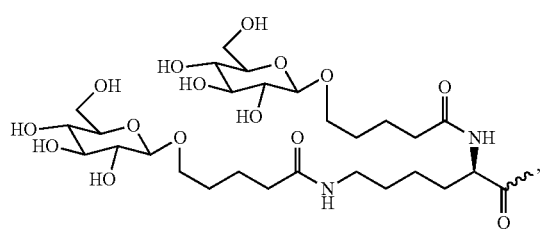
Formula XIX
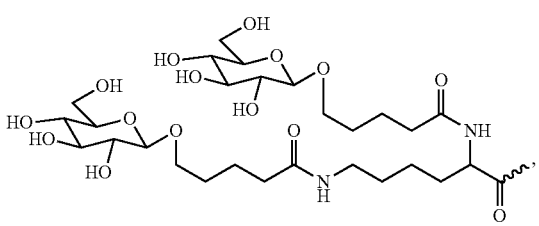
Formula XX
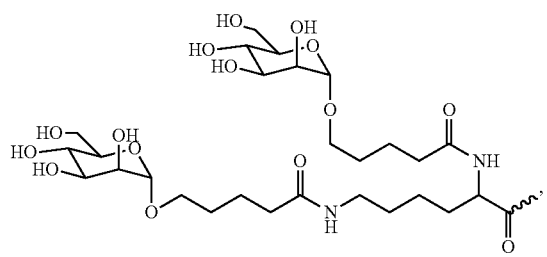
Formula XXI
Formula XXII
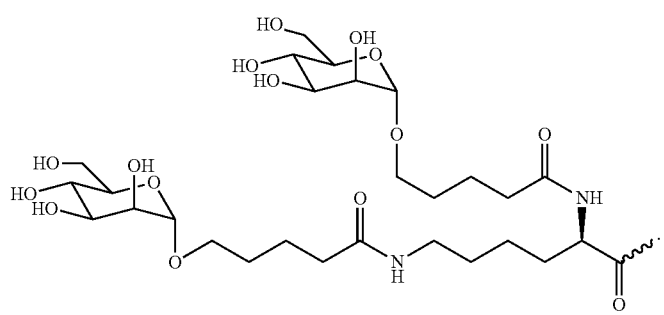

In one embodiment, the monosaccharide is an N-acetyl-galactosamine, such as

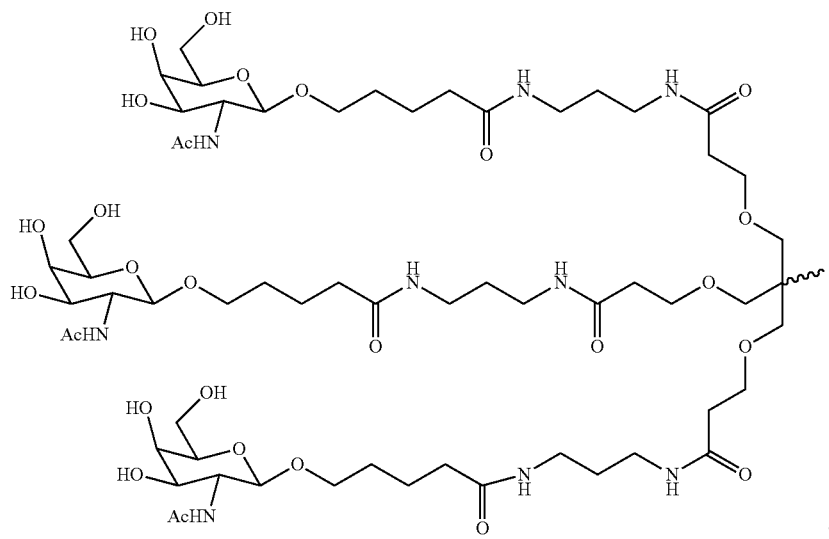 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

Another representative carbohydrate conjugate for use in the embodiments described herein includes, but is not limited to, In one embodiment, the double stranded RNAi agents of the invention comprise one GalNAc or GalNAc derivative Formula II

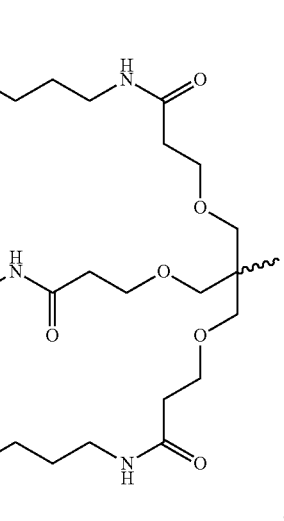

attached to the iRNA agent. In another embodiment, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide

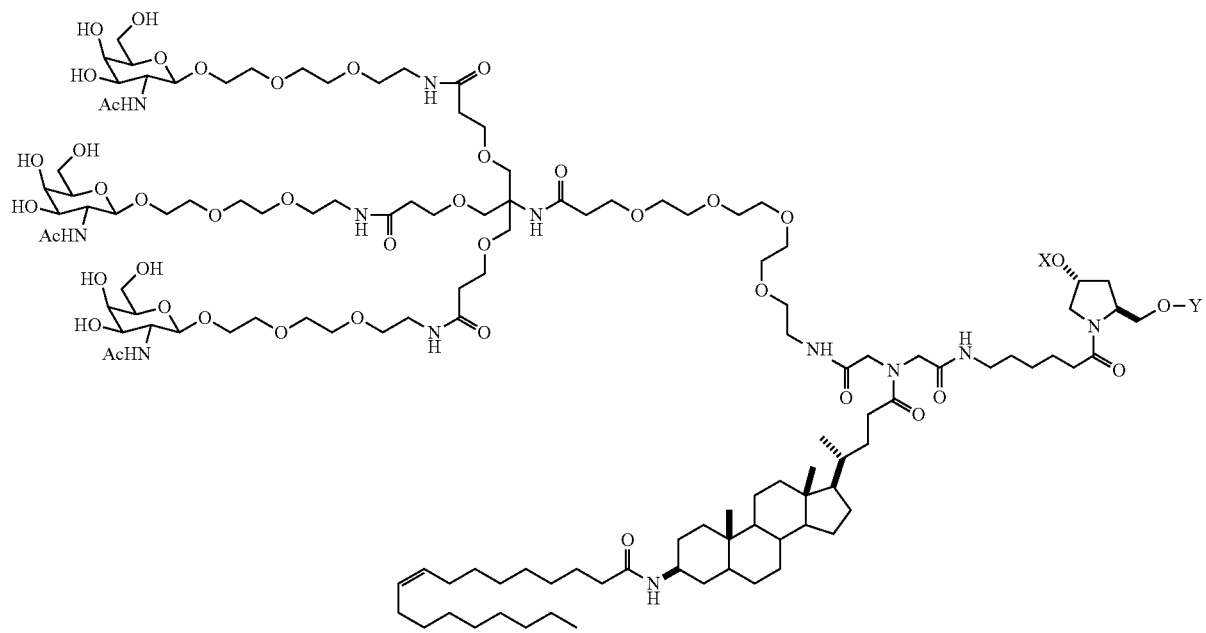

(Formula XXIII), when one of X or Y is an oligonucleotide, the other is a hydrogen.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker.

within the hairpin loop may independently comprise a GalNAc or GalNAc derivative attached via a monovalent linker.

In some embodiments, the carbohydrate conjugate further comprises one or more additional ligands as described above, such as, but not limited to, a PK modulator and/or a cell permeation peptide.

Additional carbohydrate conjugates suitable for use in the present invention include those described in PCT Publication Nos. WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2NH$ or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, substituted or unsubstituted heterocyclic; where R8 is hydrogen, acyl, aliphatic or substituted aliphatic. In one embodiment, the linker is between about 1-24 atoms, 2-24, 3-24, 4-24, 5-24, 6-24, 6-18, 7-18, 8-18 atoms, 7-17, 8-17, 6-16, 7-16, or 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least about 10 times, 20, times, 30 times, 40 times, 50 times, 60 times, 70 times, 80 times, 90 times or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least about 2, 4, 10, 20, 30, 40, 50, 60, 70, 80, 90, or about 100 times faster in the cell (or under in vitro conditions selected to mimic intracellular conditions) as compared to blood or serum (or under in vitro conditions selected to mimic extracellular conditions).

i. Redox Cleavable Linking Groups

In one embodiment, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In another embodiment, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Preferred embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, —O—P(S)(H)—S—. A preferred embodiment is —O—P(O)(OH)—O—. These candidates can be evaluated using methods analogous to those described above.

iii. Acid Cleavable Linking Groups

In another embodiment, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

In another embodiment, a cleavable linker comprises an ester-based cleavable linking group. An ester-based cleavable linking group is cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

v. Peptide-Based Cleaving Groups

In yet another embodiment, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O) NHCHRBC(O)—, where RA and RB are the R groups of the two adjacent amino acids. These candidates can be evaluated using methods analogous to those described above.

In one embodiment, an iRNA of the invention is conjugated to a carbohydrate through a linker. Non-limiting examples of iRNA carbohydrate conjugates with linkers of the compositions and methods of the invention include, but are not limited to, (Formula XXIV)

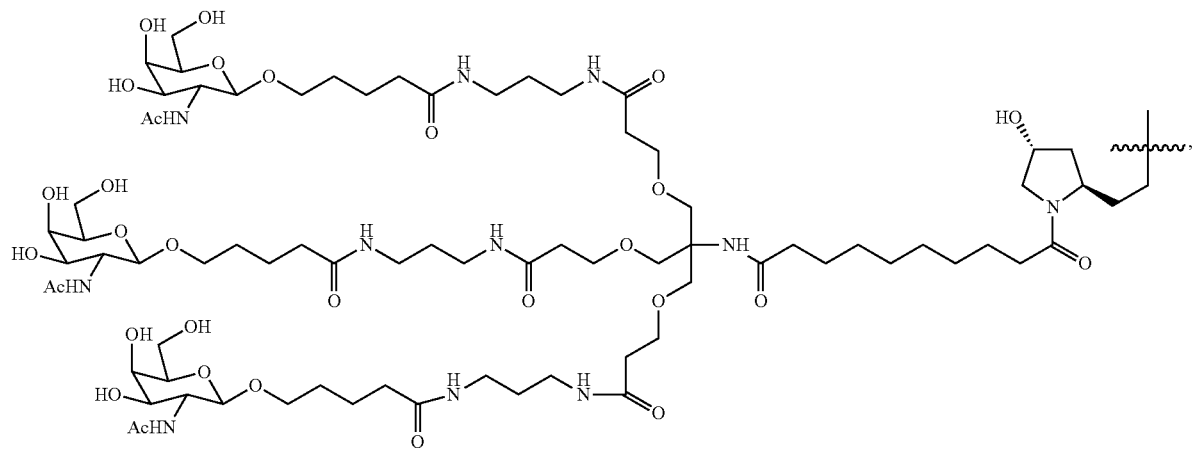

(Formula XXV)
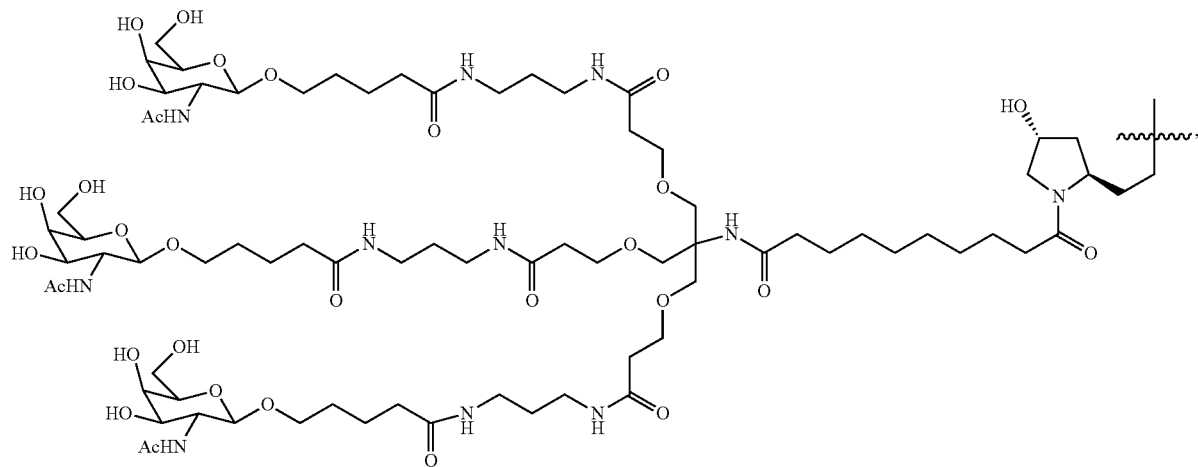
(Formula XXVI)
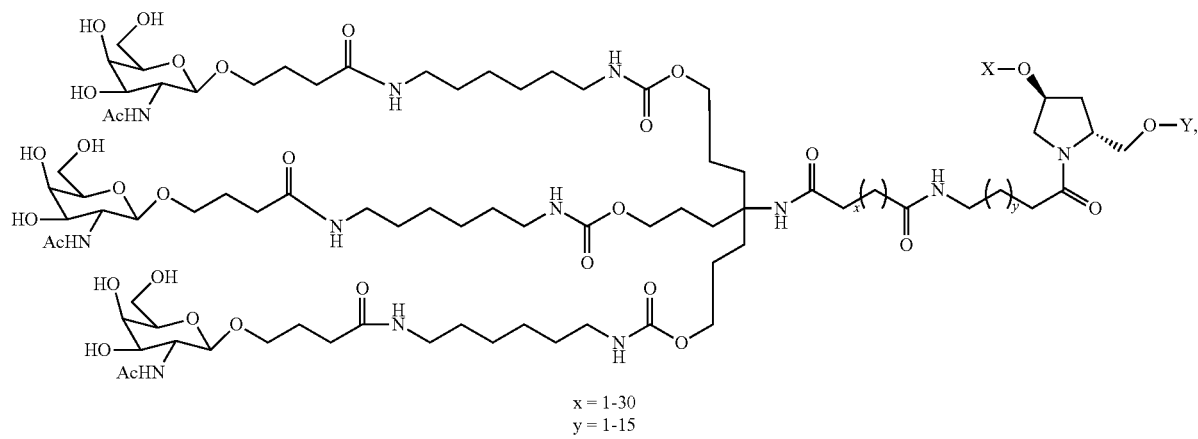
x = 1-30
y = 1-15
(Formula XXVII)
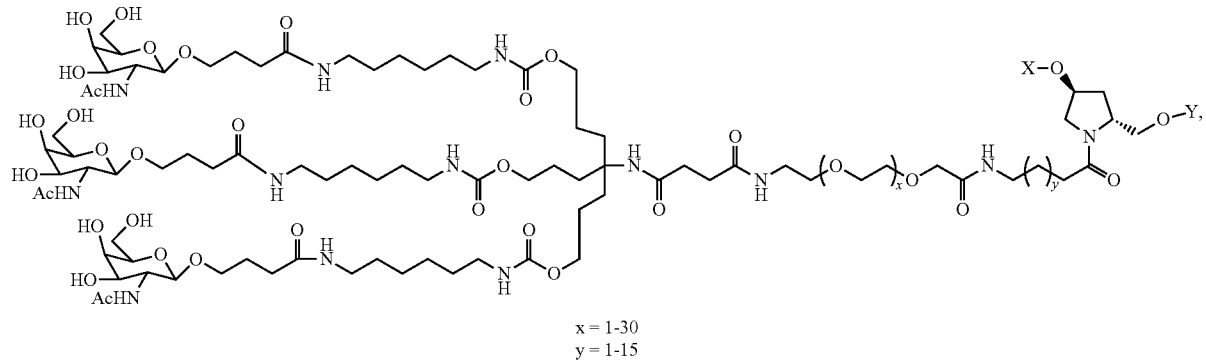
x = 1-30
y = 1-15

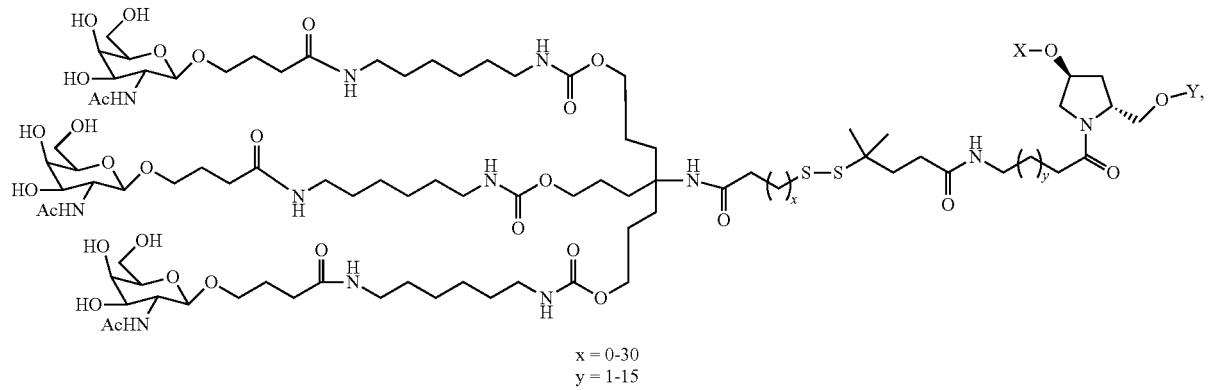
(Formula XXVIII)
x = 0-30
y = 1-15
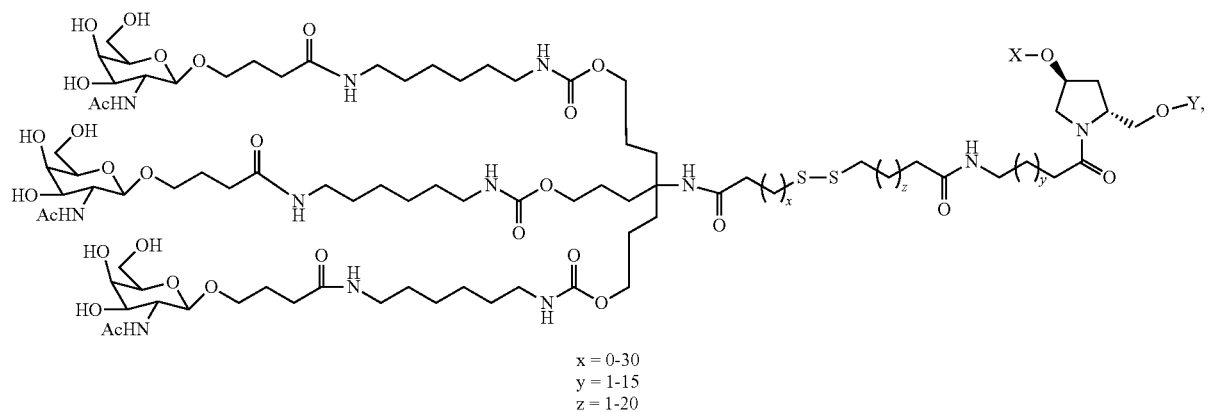
(Formula XXIX)
x = 0-30
y = 1-15
z = 1-20
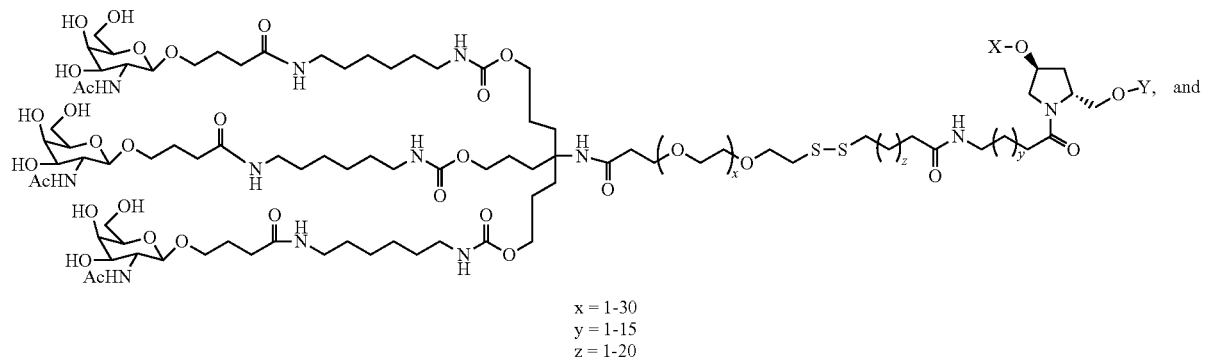
(Formula XXX)
x = 1-30
y = 1-15
z = 1-20
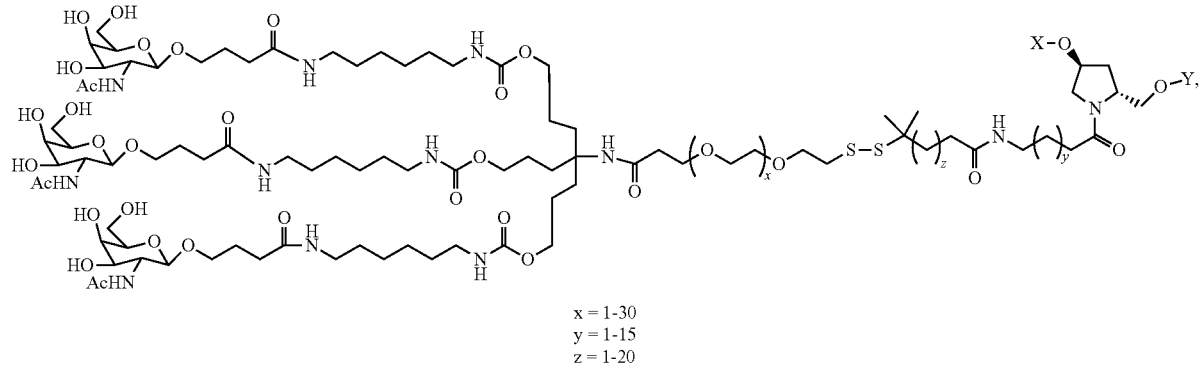
(Formula XXXI)
x = 1-30
y = 1-15
z = 1-20 when one of X or Y is an oligonucleotide, the other is a hydrogen.

In certain embodiments of the compositions and methods of the invention, a ligand is one or more "GalNAc" (N-acetylgalactosamine) derivatives attached through a bivalent or trivalent branched linker.

In one embodiment, a dsRNA of the invention is conjugated to a bivalent or trivalent branched linker selected from the group of structures shown in any of formula (XXXII)-(XXXV)

Formula XXXII
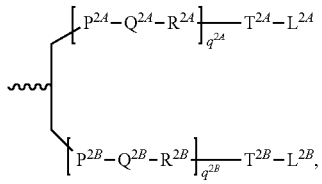

Formula XXXIII
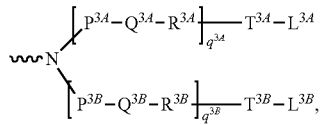

Formula XXXIV
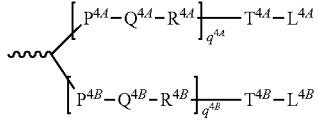

Formula XXXV
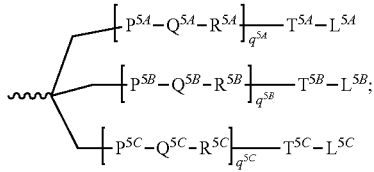

wherein:
q2A, q2B, q3A, q3B, q4A, q4B, q5A, q5B and q5C represent independently for each occurrence 0-20 and wherein the repeating unit can be the same or different;
$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5}c$ are each independently for each occurrence absent, CO, NH, O, S, OC(O), NHC(O), $CH_2$, $CH_2NH$ or $CH_2O$;
$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), $SO_2$, $N(R^N)$, C(R')=C(R''), C≡C or C(O);
$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, $CH_2$, C(O)O, C(O)NH, $NHCH(R^a)C(O)$, —C(O)—CH($R^a$)—NH—, CO, CH=N—O,

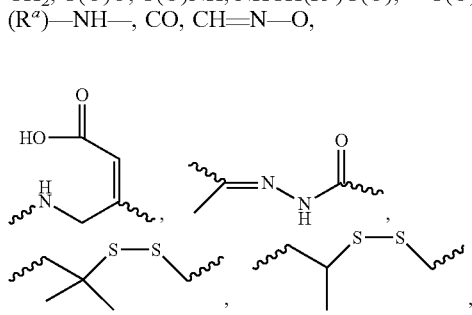

or heterocyclyl;
$L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain. Trivalent conjugating GalNAc derivatives are particularly useful for use with RNAi agents for inhibiting the expression of a target gene, such as those of formula (XXXV):

Formula XXXV
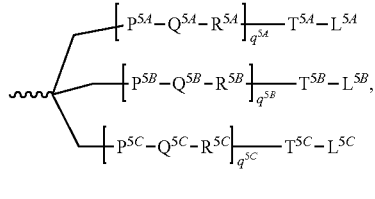

wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative U.S. patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931; 6,900,297; 7,037,646; 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, preferably dsRNAs, which contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, and/or increased binding affinity for the target nucleic acid. An additional region of the iRNA can serve as a substrate for enzymes capable of cleaving RNa:DNA or RNA:RNA hybrids. By way of example, RNase H is a cellular endonuclease which cleaves the RNa strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., Biochem. Biophys. Res. Comm., 2007, 365(1):54-61; Letsinger et al., Proc. Natl. Acad. Sci. USA, 1989, 86:6553), cholic acid (Manoharan et al., Bioorg. Med. Chem. Lett., 1994, 4:1053), a thioether, e.g., hexyl-S-tritylthiol (Manoharan et al., Ann. N.Y. Acad. Sci., 1992, 660:306; Manoharan et al., Bioorg. Med. Chem. Let., 1993, 3:2765), a thiocholesterol (Oberhauser et al., Nucl. Acids Res., 1992, 20:533), an aliphatic chain, e.g., dodecandiol or undecyl residues (Saison-Behmoaras et al., EMBO J., 1991, 10:111; Kabanov et al., FEBS Lett., 1990, 259:327; Svinarchuk et al., Biochimie, 1993, 75:49), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36:3651; Shea et al., Nucl. Acids Res., 1990, 18:3777), a polyamine or a polyethylene glycol chain (Manoharan et al., Nucleosides & Nucleotides, 1995, 14:969), or adamantane acetic acid (Manoharan et al., Tetrahedron Lett., 1995, 36:3651), a palmityl moiety (Mishra et al., Biochim. Biophys. Acta, 1995, 1264:229), or an octadecylamine or hexylamino-carbonyl-oxycholesterol moiety (Crooke et al., J. Pharmacol. Exp. Ther., 1996, 277:923). Representative United States patents that teach the preparation of such RNA conjugates have been listed above. Typical conjugation protocols involve the synthesis of an RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

V. Delivery of an iRNA of the Invention

The delivery of an iRNA of the invention to a cell e.g., a cell within a subject, such as a human subject (e.g., a subject in need thereof, such as a subject having a disease, disorder or condition associated with contact activation pathway gene expression) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in vivo delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S. and Julian R L. (1992) Trends Cell. Biol. 2(5):139-144 and WO94/02595, which are incorporated herein by reference in their entireties). For in vivo delivery, factors to consider in order to deliver an iRNA molecule include, for example, biological stability of the delivered molecule, prevention of non-specific effects, and accumulation of the delivered molecule in the target tissue. The non-specific effects of an iRNA can be minimized by local administration, for example, by direct injection or implantation into a tissue or topically administering the preparation. Local administration to a treatment site maximizes local concentration of the agent, limits the exposure of the agent to systemic tissues that can otherwise be harmed by the agent or that can degrade the agent, and permits a lower total dose of the iRNA molecule to be administered. Several studies have shown successful knockdown of gene products when an iRNA is administered locally. For example, intraocular delivery of a VEGF dsRNA by intravitreal injection in cynomolgus monkeys (Tolentino, M J., et al (2004) Retina 24:132-138) and subretinal injections in mice (Reich, S J., et al (2003) Mol. Vis. 9:210-216) were both shown to prevent neovascularization in an experimental model of age-related macular degeneration. In addition, direct intratumoral injection of a dsRNA in mice reduces tumor volume (Pille, J., et al (2005) Mol. Ther. 11:267-274) and can prolong survival of tumor-bearing mice (Kim, W J., et al (2006) Mol. Ther. 14:343-350; Li, S., et al (2007) Mol. Ther. 15:515-523). RNA interference has also shown success with local delivery to the CNS by direct injection (Dorn, G., et al. (2004) Nucleic Acids 32:e49; Tan, P H., et al (2005) Gene Ther. 12:59-66; Makimura, H., et al (2002) BMC Neurosci. 3:18; Shishkina, G T., et al (2004) Neuroscience 129:521-528; Thakker, E R., et al (2004) Proc. Natl. Acad. Sci. U.S.A. 101:17270-17275; Akaneya, Y., et al (2005) J. Neurophysiol. 93:594-602) and to the lungs by intranasal administration (Howard, K A., et al (2006) Mol. Ther. 14:476-484; Zhang, X., et al (2004) J. Biol. Chem. 279:10677-10684; Bitko, V., et al (2005) Nat. Med. 11:50-55). For administering an iRNA systemically for the treatment of a disease, the RNA can be modified or alternatively delivered using a drug delivery system; both methods act to prevent the rapid degradation of the dsRNA by endo- and exo-nucleases in vivo. Modification of the RNA or the pharmaceutical carrier can also permit targeting of the iRNA composition to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) Nature 432:173-178). Conjugation of an iRNA to an aptamer has been shown to inhibit tumor growth and mediate tumor regression in a mouse model of prostate cancer (McNamara, J O., et al (2006) Nat. Biotechnol. 24:1005-1015). In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H., et al (2008) Journal of Controlled Release 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R., et al (2003) *J. Mol. Biol* 327:761-766; Verma, U N., et al (2003) *Clin. Cancer Res.* 9:1291-1300; Arnold, A S et al (2007) *J. Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N., et al (2003), supra), Oligofectamine, "solid nucleic acid lipid particles" (Zimmermann, T S., et al (2006) *Nature* 441:111-114), cardiolipin (Chien, P Y., et al (2005) *Cancer Gene Ther.* 12:321-328; Pal, A., et al (2005) *Int J. Oncol.* 26:1087-1091), polyethyleneimine (Bonnet M E., et al (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A., et al (2007) *Biochem. Soc. Trans.* 35:61-67; Yoo, H., et al (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

A. Vector Encoded iRNAs of the Invention iRNA targeting a contact activation pathway gene can be expressed from transcription units inserted into DNA or RNA vectors (see, e.g., Couture, A, et al., *TIG.* (1996), 12:5-10; Skillern, A., et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., *Proc. Natl. Acad. Sci. USA* (1995) 92:1292).

The individual strand or strands of an iRNA can be transcribed from a promoter on an expression vector. Where two separate strands are to be expressed to generate, for example, a dsRNA, two separate expression vectors can be co-introduced (e.g., by transfection or infection) into a target cell. Alternatively each individual strand of a dsRNA can be transcribed by promoters both of which are located on the same expression plasmid. In one embodiment, a dsRNA is expressed as inverted repeat polynucleotides joined by a linker polynucleotide sequence such that the dsRNA has a stem and loop structure.

iRNA expression vectors are generally DNA plasmids or viral vectors. Expression vectors compatible with eukaryotic cells, preferably those compatible with vertebrate cells, can be used to produce recombinant constructs for the expression of an iRNA as described herein. Eukaryotic cell expression vectors are well known in the art and are available from a number of commercial sources. Typically, such vectors are provided containing convenient restriction sites for insertion of the desired nucleic acid segment. Delivery of iRNA expressing vectors can be systemic, such as by intravenous or intramuscular administration, by administration to target cells ex-planted from the patient followed by reintroduction into the patient, or by any other means that allows for introduction into a desired target cell.

iRNA expression plasmids can be transfected into target cells as a complex with cationic lipid carriers (e.g., Oligofectamine) or non-cationic lipid-based carriers (e.g., Transit-TKO™) Multiple lipid transfections for iRNA-mediated knockdowns targeting different regions of a target RNA over a period of a week or more are also contemplated by the invention. Successful introduction of vectors into host cells can be monitored using various known methods. For example, transient transfection can be signaled with a reporter, such as a fluorescent marker, such as Green Fluorescent Protein (GFP). Stable transfection of cells ex vivo can be ensured using markers that provide the transfected cell with resistance to specific environmental factors (e.g., antibiotics and drugs), such as hygromycin B resistance.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are further described below.

Vectors useful for the delivery of an iRNA will include regulatory elements (promoter, enhancer, etc.) sufficient for expression of the iRNA in the desired target cell or tissue. The regulatory elements can be chosen to provide either constitutive or regulated/inducible expression.

Expression of the iRNA can be precisely regulated, for example, by using an inducible regulatory sequence that is sensitive to certain physiological regulators, e.g., circulating glucose levels, or hormones (Docherty et al., 1994, *FASEB J.* 8:20-24). Such inducible expression systems, suitable for the control of dsRNA expression in cells or in mammals include, for example, regulation by ecdysone, by estrogen, progesterone, tetracycline, chemical inducers of dimerization, and isopropyl-beta-D1-thiogalactopyranoside (IPTG). A person skilled in the art would be able to choose the appropriate regulatory/promoter sequence based on the intended use of the iRNA transgene.

Viral vectors that contain nucleic acid sequences encoding an iRNA can be used. For example, a retroviral vector can be used (see Miller et al., *Meth. Enzymol.* 217:581-599 (1993)). These retroviral vectors contain the components necessary for the correct packaging of the viral genome and integration into the host cell DNA. The nucleic acid sequences encoding an iRNA are cloned into one or more vectors, which facilitate delivery of the nucleic acid into a patient. More detail about retroviral vectors can be found, for example, in Boesen et al., *Biotherapy* 6:291-302 (1994), which describes the use of a retroviral vector to deliver the mdr1 gene to hematopoietic stem cells in order to make the stem cells more resistant to chemotherapy. Other references illustrating the use of retroviral vectors in gene therapy are: Clowes et al., *J. Clin. Invest.* 93:644-651 (1994); Kiem et al., Blood 83:1467-1473 (1994); Salmons and Gunzberg, *Human Gene Therapy* 4:129-141 (1993); and Grossman and Wilson, *Curr. Opin. in Genetics and Devel.* 3:110-114 (1993). Lentiviral vectors contemplated for use include, for example, the HIV based vectors described in U.S. Pat. Nos. 6,143,520; 5,665,557; and 5,981,276, which are herein incorporated by reference.

Adenoviruses are also contemplated for use in delivery of iRNAs of the invention. Adenoviruses are especially attractive vehicles, e.g., for delivering genes to respiratory epithelia. Adenoviruses naturally infect respiratory epithelia where they cause a mild disease. Other targets for adenovirus-based delivery systems are liver, the central nervous system, endothelial cells, and muscle. Adenoviruses have the advantage of being capable of infecting non-dividing cells. Kozarsky and Wilson, *Current Opinion in Genetics and Development* 3:499-503 (1993) present a review of adenovirus-based gene therapy. Bout et al., *Human Gene Therapy* 5:3-10 (1994) demonstrated the use of adenovirus vectors to transfer genes to the respiratory epithelia of rhesus monkeys. Other instances of the use of adenoviruses in gene therapy can be found in Rosenfeld et al., *Science* 252:431-434 (1991); Rosenfeld et al., *Cell* 68:143-155 (1992); Mastrangeli et al., *J. Clin. Invest.* 91:225-234 (1993); PCT Publication WO94/12649; and Wang, et al., *Gene Therapy* 2:775-783 (1995). A suitable AV vector for expressing an iRNA featured in the invention, a method for constructing the recombinant AV vector, and a method for delivering the vector into target cells, are described in Xia H et al. (2002), *Nat. Biotech.* 20: 1006-1010.

Adeno-associated virus (AAV) vectors may also be used to delivery an iRNA of the invention (Walsh et al., *Proc. Soc. Exp. Biol. Med.* 204:289-300 (1993); U.S. Pat. No. 5,436,146). In one embodiment, the iRNA can be expressed as two separate, complementary single-stranded RNA molecules from a recombinant AAV vector having, for example, either the U6 or H1 RNA promoters, or the cytomegalovirus (CMV) promoter. Suitable AAV vectors for expressing the dsRNA featured in the invention, methods for constructing the recombinant AV vector, and methods for delivering the vectors into target cells are described in Samulski R et al. (1987), *J. Virol.* 61: 3096-3101; Fisher K J et al. (1996), *J. Virol,* 70: 520-532; Samulski R et al. (1989), *J. Virol.* 63: 3822-3826; U.S. Pat. Nos. 5,252,479; 5,139,941; International Patent Application No. WO 94/13788; and International Patent Application No. WO 93/24641, the entire disclosures of which are herein incorporated by reference.

Another viral vector suitable for delivery of an iRNA of the inevtion is a pox virus such as a vaccinia virus, for example an attenuated vaccinia such as Modified Virus Ankara (MVA) or NYVAC, an avipox such as fowl pox or canary pox.

The tropism of viral vectors can be modified by pseudo-typing the vectors with envelope proteins or other surface antigens from other viruses, or by substituting different viral capsid proteins, as appropriate. For example, lentiviral vectors can be pseudotyped with surface proteins from vesicular stomatitis virus (VSV), rabies, Ebola, Mokola, and the like. AAV vectors can be made to target different cells by engineering the vectors to express different capsid protein serotypes; see, e.g., Rabinowitz J E et al. (2002), *J Virol* 76:791-801, the entire disclosure of which is herein incorporated by reference.

The pharmaceutical preparation of a vector can include the vector in an acceptable diluent, or can include a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

VI. Pharmaceutical Compositions of the Invention

The present invention also includes pharmaceutical compositions and formulations which include the iRNAs of the invention. In one embodiment, provided herein are pharmaceutical compositions containing an iRNA, as described herein, and a pharmaceutically acceptable carrier. The pharmaceutical compositions containing the iRNA are useful for treating a disease or disorder associated with the expression or activity of a contact activation pathway gene (i.e., a KLKB1 gene, an F12 gene, and/or a KNG1 gene). Such pharmaceutical compositions are formulated based on the mode of delivery. One example is compositions that are formulated for systemic administration via parenteral delivery, e.g., by subcutaneous (SC), intramuscular (IM), or intravenous (IV) delivery. Another example is compositions that are formulated for direct delivery into the brain parenchyma, e.g., by infusion into the brain, such as by continuous pump infusion. The pharmaceutical compositions of the invention may be administered in dosages sufficient to inhibit expression of a contact activation pathway gene.

Such pharmaceutical compositions are formulated based on the mode of delivery. One example is compositions that are formulated for systemic administration via parenteral delivery, e.g., by intravenous (IV) or for subcutaneous delivery. Another example is compositions that are formulated for direct delivery into the liver, e.g., by infusion into the liver, such as by continuous pump infusion.

The pharmaceutical compositions of the invention may be administered in dosages sufficient to inhibit expression of a contact activation pathway gene. In general, a suitable dose of an iRNA of the invention will be in the range of about 0.001 to about 200.0 milligrams per kilogram body weight of the recipient per day, generally in the range of about 1 to 50 mg per kilogram body weight per day. Typically, a suitable dose of an iRNA of the invention will be in the range of about 0.1 mg/kg to about 5.0 mg/kg, preferably about 0.3 mg/kg and about 3.0 mg/kg. A repeat-dose regimen may include administration of a therapeutic amount of iRNA on a regular basis, such as every other day or once a year. In certain embodiments, the iRNA is administered about once per month to about once per quarter (i.e., about once every three months).

After an initial treatment regimen, the treatments can be administered on a less frequent basis.

The skilled artisan will appreciate that certain factors can influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual iRNAs encompassed by the invention can be made using conventional methodologies or on the basis of in vivo testing using an appropriate animal model, as described elsewhere herein.

Advances in mouse genetics have generated a number of mouse models for the study of various human diseases, such as disorders that would benefit from reduction in the expression of a contact activation pathway gene.

The pharmaceutical compositions of the present invention can be administered in a number of ways depending upon whether local or systemic treatment is desired and upon the area to be treated. Administration can be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration.

The iRNA can be delivered in a manner to target a particular tissue, such as the liver (e.g., the hepatocytes of the liver).

Pharmaceutical compositions and formulations for topical administration can include transdermal patches, ointments, lotions, creams, gels, drops, suppositories, sprays, liquids, and powders. Conventional pharmaceutical carriers, aqueous, powder, or oily bases, thickeners and the like can be necessary or desirable. Coated condoms, gloves and the like can also be useful. Suitable topical formulations include those in which the iRNAs featured in the invention are in admixture with a topical delivery agent such as lipids, liposomes, fatty acids, fatty acid esters, steroids, chelating agents, and surfactants. Suitable lipids and liposomes include neutral (e.g., dioleoylphosphatidyl DOPE ethanolamine, dimyristoylphosphatidyl choline DMPC, distearolyphosphatidyl choline), negative (e.g., dimyristoylphosphatidyl glycerol DMPG), and cationic (e.g., dioleoyltetramethylaminopropyl DOTAP and dioleoylphosphatidyl ethanolamine DOTMA). iRNAs featured in the invention can be encapsulated within liposomes or can form complexes thereto, in particular to cationic liposomes. Alternatively, iRNAs can be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-20}$ alkyl ester (e.g., isopropylmyristate IPM), monoglyceride or diglyceride; or pharmaceutically acceptable salt thereof. Topical formulations are described in detail in U.S. Pat. No. 6,747,014, which is incorporated herein by reference.

A. iRNA Formulations Comprising Membranous Molecular Assemblies

An iRNA for use in the compositions and methods of the invention can be formulated for delivery in a membranous molecular assembly, e.g., a liposome or a micelle. As used herein, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the iRNA composition. The lipophilic material isolates the aqueous interior from an aqueous exterior, which typically does not include the iRNA composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the iRNA are delivered into the cell where the iRNA can specifically bind to a target RNA and can mediate iRNA. In some cases the liposomes are also specifically targeted, e.g., to direct the iRNA to particular cell types.

A liposome containing an iRNA agent can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The iRNA agent preparation is then added to the micelles that include the lipid component. The cationic groups on the lipid interact with the iRNA agent and condense around the iRNA agent to form a liposome. After condensation, the detergent is removed, e.g., by dialysis, to yield a liposomal preparation of iRNA agent.

If necessary a carrier compound that assists in condensation can be added during the condensation reaction, e.g., by controlled addition. For example, the carrier compound can be a polymer other than a nucleic acid (e.g., spermine or spermidine). pH can also adjusted to favor condensation.

Methods for producing stable polynucleotide delivery vehicles, which incorporate a polynucleotide/cationic lipid complex as structural components of the delivery vehicle, are further described in, e.g., WO 96/37194, the entire contents of which are incorporated herein by reference. Liposome formation can also include one or more aspects of exemplary methods described in Felgner, P. L. et al., *Proc. Natl. Acad. Sci., USA* 8:7413-7417, 1987; U.S. Pat. Nos. 4,897,355; 5,171,678; Bangham, et al. *M. Mol. Biol.* 23:238, 1965; Olson, et al. *Biochim. Biophys. Acta* 557:9, 1979; Szoka, et al. *Proc. Natd. Acad. Sci.* 75: 4194, 1978; Mayhew, et al. *Biochim. Biophys. Acta* 775:169, 1984; Kim, et al. *Biochim. Biophys. Acta* 728:339, 1983; and Fukunaga, et al. *Endocrinol.* 115:757, 1984. Commonly used techniques for preparing lipid aggregates of appropriate size for use as delivery vehicles include sonication and freeze-thaw plus extrusion (see, e.g., Mayer, et al. *Biochim. Biophys. Acta* 858:161, 1986). Microfluidization can be used when consistently small (50 to 200 nm) and relatively uniform aggregates are desired (Mayhew, et al. *Biochim. Biophys. Acta* 775:169, 1984). These methods are readily adapted to packaging iRNA agent preparations into liposomes.

Liposomes fall into two broad classes. Cationic liposomes are positively charged liposomes which interact with the negatively charged nucleic acid molecules to form a stable complex. The positively charged nucleic acid/liposome complex binds to the negatively charged cell surface and is internalized in an endosome. Due to the acidic pH within the endosome, the liposomes are ruptured, releasing their contents into the cell cytoplasm (Wang et al., *Biochem. Biophys. Res. Commun.*, 1987, 147, 980-985).

Liposomes which are pH-sensitive or negatively-charged, entrap nucleic acids rather than complex with it. Since both the nucleic acid and the lipid are similarly charged, repulsion rather than complex formation occurs. Nevertheless, some nucleic acid is entrapped within the aqueous interior of these liposomes. pH-sensitive liposomes have been used to deliver nucleic acids encoding the thymidine kinase gene to cell monolayers in culture. Expression of the exogenous gene was detected in the target cells (Zhou et al., *Journal of Controlled Release*, 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Examples of other methods to introduce liposomes into cells in vitro and in vivo include U.S. Pat. Nos. 5,283,185; 5,171,678; WO 94/00569; WO 93/24640; WO 91/16024; Felgner, *J. Biol. Chem.* 269:2550, 1994; Nabel, *Proc. Natl. Acad. Sci.* 90:11307, 1993; Nabel, *Human Gene Ther.* 3:649, 1992; Gershon, *Biochem.* 32:7143, 1993; and Strauss *EMBO J.* 11:417, 1992.

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporine A into different layers of the skin (Hu et al. *S.T.P. Pharma. Sci.*, 1994, 4(6) 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., *FEBS Letters*, 1987, 223, 42; Wu et al., *Cancer Research*, 1993, 53, 3765).

Various liposomes comprising one or more glycolipids are known in the art. Papahadjopoulos et al. (*Ann. N.Y. Acad. Sci.*, 1987, 507, 64) reported the ability of monosialoganglioside $G_{M1}$, galactocerebroside sulfate and phosphatidylinositol to improve blood half-lives of liposomes. These findings were expounded upon by Gabizon et al. (*Proc. Natl. Acad. Sci. U.S.A.*, 1988, 85, 6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

In one embodiment, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver iRNA agents to macrophages.

Further advantages of liposomes include: liposomes obtained from natural phospholipids are biocompatible and biodegradable; liposomes can incorporate a wide range of water and lipid soluble drugs; liposomes can protect encapsulated iRNA agents in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of iRNA agent (see, e.g., Felgner, P. L. et al., *Proc. Natl. Acad. Sci., USA* 8:7413-7417, 1987 and U.S. Pat. No. 4,897,355 for a description of DOTMA and its use with DNA).

A DOTMA analogue, 1,2-bis(oleoyloxy)-3-(trimethylammonia)propane (DOTAP) can be used in combination with a phospholipid to form DNA-complexing vesicles. Lipofectin™ Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis(oleoyloxy)-3,3-(trimethylammonia)propane ("DOTAP") (Boehringer Mannheim, Indianapolis, Indiana) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (Transfectam™, Promega, Madison, Wisconsin) and dipalmitoylphosphatidylethanolamine 5-carboxyspermylamide ("DPPES") (see, e.g., U.S. Pat. No. 5,171,678).

Another cationic lipid conjugate includes derivatization of the lipid with cholesterol ("DC-Chol") which has been formulated into liposomes in combination with DOPE (See, Gao, X. and Huang, L., *Biochim. Biophys. Res. Commun.* 179:280, 1991). Lipopolylysine, made by conjugating polylysine to DOPE, has been reported to be effective for transfection in the presence of serum (Zhou, X. et al., *Biochim. Biophys. Acta* 1065:8, 1991). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, California) and Lipofectamine (DOSPA) (Life Technology, Inc., Gaithersburg, Maryland). Other cationic lipids suitable for the delivery of oligonucleotides are described in WO 98/39359 and WO 96/37194.

Liposomal formulations are particularly suited for topical administration, liposomes present several advantages over other formulations. Such advantages include reduced side effects related to high systemic absorption of the administered drug, increased accumulation of the administered drug at the desired target, and the ability to administer iRNA agent into the skin. In some implementations, liposomes are used for delivering iRNA agent to epidermal cells and also to enhance the penetration of iRNA agent into dermal tissues, e.g., into skin. For example, the liposomes can be applied topically. Topical delivery of drugs formulated as liposomes to the skin has been documented (see, e.g., Weiner et al., *Journal of Drug Targeting*, 1992, vol. 2, 405-410 and du Plessis et al., *Antiviral Research*, 18, 1992, 259-265; Mannino, R. J. and Fould-Fogerite, S., Biotechniques 6:682-690, 1988; Itani, T. et al. *Gene* 56:267-276. 1987; Nicolau, C. et al. *Meth. Enz.* 149:157-176, 1987; Straubinger, R. M. and Papahadjopoulos, D. *Meth. Enz.* 101:512-527, 1983; Wang, C. Y. and Huang, L., *Proc. Natl. Acad. Sci. USA* 84:7851-7855, 1987).

Non-ionic liposomal systems have also been examined to determine their utility in the delivery of drugs to the skin, in particular systems comprising non-ionic surfactant and cholesterol. Non-ionic liposomal formulations comprising Novasome I (glyceryl dilaurate/cholesterol/polyoxyethylene-10-stearyl ether) and Novasome II (glyceryl distearate/cholesterol/polyoxyethylene-10-stearyl ether) were used to deliver a drug into the dermis of mouse skin. Such formulations with iRNA agent are useful for treating a dermatological disorder.

Liposomes that include iRNA can be made highly deformable. Such deformability can enable the liposomes to penetrate through pore that are smaller than the average radius of the liposome. For example, transfersomes are a type of deformable liposomes. Transferosomes can be made by adding surface edge activators, usually surfactants, to a standard liposomal composition. Transfersomes that include iRNA agent can be delivered, for example, subcutaneously by infection in order to deliver iRNA agent to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transferosomes can be self-optimizing (adaptive to the shape of pores, e.g., in the skin), self-repairing, and can frequently reach their targets without fragmenting, and often self-loading.

Other formulations amenable to the present invention are described in U.S. provisional application Ser. No. 61/018, 616, filed Jan. 2, 2008; 61/018,611, filed Jan. 2, 2008; 61/039,748, filed Mar. 26, 2008; 61/047,087, filed Apr. 22, 2008 and 61/051,528, filed May 8, 2008. PCT application no PCT/US2007/080331, filed Oct. 3, 2007 also describes formulations that are amenable to the present invention.

Transfersomes are yet another type of liposomes, and are highly deformable lipid aggregates which are attractive candidates for drug delivery vehicles. Transfersomes can be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in "Pharmaceutical Dosage Forms", Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in "Pharmaceutical Dosage Forms", Marcel Dekker, Inc., New York, N.Y., 1988, p. 285).

The iRNA for use in the methods of the invention can also be provided as micellar formulations. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of the siRNA composition, an alkali metal $C_8$ to $C_{22}$ alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the siRNA composition and at least the alkali metal alkyl sulphate. The first micellar composition is then mixed with at least three micelle forming compounds to form a mixed micellar composition. In another method, the micellar composition is prepared by mixing the siRNA composition, the alkali metal alkyl sulphate and at least one of the micelle forming compounds, followed by addition of the remaining micelle forming compounds, with vigorous mixing.

Phenol and/or m-cresol may be added to the mixed micellar composition to stabilize the formulation and protect against bacterial growth. Alternatively, phenol and/or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether and diethyl ether. In certain embodiments, HFA 134a (1,1,1,2 tetrafluoroethane) may be used.

The specific concentrations of the essential ingredients can be determined by relatively straightforward experimentation. For absorption through the oral cavities, it is often desirable to increase, e.g., at least double or triple, the dosage for through injection or administration through the gastrointestinal tract.

B. Lipid Particles iRNAs, e.g., dsRNAs of in the invention may be fully encapsulated in a lipid formulation, e.g., a LNP, or other nucleic acid-lipid particle.

As used herein, the term "LNP" refers to a stable nucleic acid-lipid particle. LNPs typically contain a cationic lipid, a non-cationic lipid, and a lipid that prevents aggregation of the particle (e.g., a PEG-lipid conjugate). LNPs are extremely useful for systemic applications, as they exhibit extended circulation lifetimes following intravenous (i.v.) injection and accumulate at distal sites (e.g., sites physically separated from the administration site). LNPs include "pSPLP," which include an encapsulated condensing agent-nucleic acid complex as set forth in PCT Publication No. WO 00/03683. The particles of the present invention typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; U.S. Publication No. 2010/0324120 and PCT Publication No. WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. Ranges intermediate to the above recited ranges are also contemplated to be part of the invention.

The cationic lipid can be, for example, N,N-dioleyl-N,N-dimethylammonium chloride (DODAC), N,N-distearyl-N,N-dimethylammonium bromide (DDAB), N—(I-(2,3-dioleyloxy)propyl)-N,N,N-trimethylammonium chloride (DOTAP), N—(I-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino)acetoxypropane (Dlin-DAC), 1,2-Dilinoleyoxy-3-morpholinopropane (DLin-MA), 1,2-Dilinoleoyl-3-dimethylaminopropane (DLinDaP), 1,2-Dilinoleylthio-3-dimethylaminopropane (DLin-S-DMA), 1-linoleoyl-2-linoleyloxy-3-dimethylaminopropane (DLin-2-DMAP), 1,2-Dilinoleyloxy-3-trimethylaminopropane chloride salt (DLin-TMA·Cl), 1,2-Dilinoleoyl-3-trimethylaminopropane chloride salt (DLin-TAP·Cl), 1,2-Dilinoleyloxy-3-(N-methylpiperazino)propane (DLin-MPz), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100), (6Z,9Z,28Z,31Z)-heptatriaconta-6,9,28,31-tetraen-19-yl 4-(dimethylamino)butanoate (MC3), 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1), or a mixture thereof. The cationic lipid can comprise from about 20 mol % to about 50 mol % or about 40 mol % of the total lipid present in the particle.

In another embodiment, the compound 2,2-Dilinoleyl-4-dimethylaminoethyl-[1,3]-dioxolane can be used to prepare lipid-siRNA nanoparticles. Synthesis of 2,2-Dilinoleyl-4-dimethylaminoethyl-[1,3]-dioxolane is described in U.S. provisional patent application No. 61/107,998 filed on Oct. 23, 2008, which is herein incorporated by reference.

In one embodiment, the lipid-siRNA particle includes 40% 2, 2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The ionizable/non-cationic lipid can be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid can be from about 5 mol % to about 90 mol %, about 10 mol %, or about 58 mol % if cholesterol is included, of the total lipid present in the particle.

The conjugated lipid that inhibits aggregation of particles can be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate can be, for example, a PEG-dilauryloxypropyl ($C_{12}$), a PEG-dimyristyloxypropyl ($C_{14}$), a PEG-dipalmityloxypropyl ($C_{16}$), or a PEG-distearyloxypropyl ($C_{18}$). The conjugated lipid that prevents aggregation of particles can be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

In one embodiment, the lipidoid ND98·4HCl (MW 1487) (see U.S. patent application Ser. No. 12/056,230, filed Mar. 26, 2008, which is incorporated herein by reference), Cho-lesterol (Sigma-Aldrich), and PEG-Ceramide C16 (Avanti Polar Lipids) can be used to prepare lipid-dsRNA nanoparticles (i.e., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous dsRNA (e.g., in sodium acetate pH 5) such that the final ethanol concentration is about 35-45% and the final sodium acetate concentration is about 100-300 mM. Lipid-dsRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

Formula 1

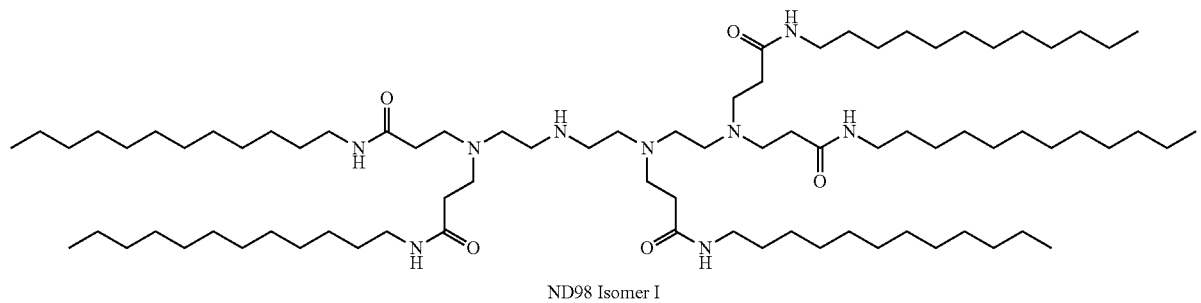

ND98 Isomer I

LNP01 formulations are described, e.g., in International Application Publication No. WO 2008/042973, which is hereby incorporated by reference.

Additional exemplary lipid-dsRNA formulations are described in Table 1.

TABLE 1

| | Ionizable/Cationic Lipid | cationic lipid/non-cationic lipid/cholesterol/PEG-lipid conjugate Lipid:siRNA ratio |
|---|---|---|
| SNALP-1 | 1,2-Dilinolenyloxy-N,N-dimethylaminopropane (DLinDMA) | DLinDMA/DPPC/Cholesterol/PEG-cDMA (57.1/7.1/34.4/1.4) lipid:siRNA ~ 7:1 |
| 2-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA ~ 7:1 |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~ 6:1 |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~ 11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~ 6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~ 11:1 |

TABLE 1-continued

| | Ionizable/Cationic Lipid | cationic lipid/non-cationic lipid/cholesterol/PEG-lipid conjugate Lipid:siRNA ratio |
|---|---|---|
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 |
| LNP10 | (3aR,5s,6aS )-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2((2-(bis(2-hydroxydodecyl)amino)ethyl)(2-hydroxydodecyl)amino)ethyl)piperazin-1-yl)ethylazanediyl)didodecan-2-ol (Tech G1) | Tech G1/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |
| LNP16 | MC3 | MC3/DSPC/Chol/PEG-DMG 50/10/38.5/1.5 Lipid:siRNA: 7:1 |
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA: 7:1 |
| LNP22 | XTC | XTC/DSPC/Chol/PEG-DSG 50/10/38.5/1.5 Lipid:siRNA: 10:1 |

DSPC: distearoylphosphatidylcholine
DPPC: dipalmitoylphosphatidylcholine
PEG-DMG: PEG-didimyristoyl glycerol (C14-PEG, or PEG-C14) (PEG with avg mol wt of 2000)
PEG-DSG: PEG-distyryl glycerol (C18-PEG, or PEG-C18) (PEG with avg mol wt of 2000)
PEG-cDMA: PEG-carbamoyl-1,2-dimyristyloxypropylamine (PEG with avg mol wt of 2000) SNALP (1,2-Dilinolenyloxy-N,N-dimethylaminopropane (DLinDMA)) comprising formulations are described in International Publication No. WO2009/127060, filed Apr. 15, 2009, which is hereby incorporated by reference.

XTC comprising formulations are described, e.g., in U.S. Provisional Ser. No. 61/148,366, filed Jan. 29, 2009; U.S. Provisional Ser. No. 61/156,851, filed Mar. 2, 2009; U.S. Provisional Serial No. filed Jun. 10, 2009; U.S. Provisional Ser. No. 61/228,373, filed Jul. 24, 2009; U.S. Provisional Ser. No. 61/239,686, filed Sep. 3, 2009, and International Application No. PCT/US2010/022614, filed Jan. 29, 2010, which are hereby incorporated by reference.

MC3 comprising formulations are described, e.g., in U.S. Publication No. 2010/0324120, filed Jun. 10, 2010, the entire contents of which are hereby incorporated by reference.

ALNY-100 comprising formulations are described, e.g., International patent application number PCT/US09/63933, filed on Nov. 10, 2009, which is hereby incorporated by reference.

C12-200 comprising formulations are described in U.S. Provisional Ser. No. 61/175,770, filed May 5, 2009 and International Application No. PCT/US10/33777, filed May 5, 2010, which are hereby incorporated by reference.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders can be desirable. In some embodiments, oral formulations are those in which dsRNAs featured in the invention are administered in conjunction with one or more penetration enhancer surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the invention can be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US Publn. No. 20030027780, and U.S. Pat. No. 6,747,014, each of which is incorporated herein by reference.

Compositions and formulations for parenteral, intraparenchymal (into the brain), intrathecal, intraventricular or intrahepatic administration can include sterile aqueous solutions which can also contain buffers, diluents and other suitable additives such as, but not limited to, penetration enhancers, carrier compounds and other pharmaceutically acceptable carriers or excipients.

Pharmaceutical compositions of the present invention include, but are not limited to, solutions, emulsions, and liposome-containing formulations. These compositions can be generated from a variety of components that include, but are not limited to, preformed liquids, self-emulsifying solids and self-emulsifying semisolids. Particularly preferred are formulations that target the liver when treating hepatic disorders such as hepatic carcinoma.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention can be formulated into any of many possible dosage forms such as, but not limited to, tablets, capsules, gel capsules, liquid syrups, soft gels, suppositories, and enemas. The compositions of the present invention can also be formulated as suspensions in aqueous, non-aqueous or mixed media. Aqueous suspensions can further contain substances which increase the viscosity of the suspension including, for example, sodium carboxymethylcellulose, sorbitol and/or dextran. The suspension can also contain stabilizers.

C. Additional Formulations i. Emulsions

The compositions of the present invention can be prepared and formulated as emulsions. Emulsions are typically heterogeneous systems of one liquid dispersed in another in the form of droplets usually exceeding 0.1 µm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution in either the aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion can be a semisolid or a solid, as is the case of emulsion-style ointment bases and creams. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that can readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used can be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

ii. Microemulsions

In one embodiment of the present invention, the compositions of iRNAs and nucleic acids are formulated as microemulsions. A microemulsion can be defined as a system of water, oil and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215).

Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions can, however, be prepared without the use of cosurfactants and alcohol-free self-emulsifying microemulsion systems are known in the art. The aqueous phase can typically be, but is not limited to, water, an aqueous solution of the drug, glycerol, PEG300, PEG400, polyglycerols, propylene glycols, and derivatives of ethylene glycol. The oil phase can include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191,105; 7,063,860; 7,070,802; 7,157,099; Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., *Pharmaceutical Research*, 1994, 11, 1385; Ho et al., *J. Pharm. Sci.*, 1996, 85, 138-143). Often microemulsions can form spontaneously when their components are brought together at ambient temperature. This can be particularly advantageous when formulating thermolabile drugs, peptides or iRNAs. Microemulsions have also been effective in the transdermal delivery of active components in both cosmetic and pharmaceutical applications. It is expected that the microemulsion compositions and formulations of the present invention will facilitate the increased systemic absorption of iRNAs and nucleic acids from the gastrointestinal tract, as well as improve the local cellular uptake of iRNAs and nucleic acids.

Microemulsions of the present invention can also contain additional components and additives such as sorbitan monostearate (Grill 3), Labrasol, and penetration enhancers to improve the properties of the formulation and to enhance the absorption of the iRNAs and nucleic acids of the present invention. Penetration enhancers used in the microemulsions of the present invention can be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

iii. Microparticles

An iRNA agent of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, NY, 2002; Lee et al., Critical Reviews in Therapeutic Drug Carrier Systems, 1991, p. 92). Each of the above mentioned classes of penetration enhancers are described below in greater detail.

Surfactants (or "surface-active agents") are chemical entities which, when dissolved in an aqueous solution, reduce the surface tension of the solution or the interfacial tension between the aqueous solution and another liquid, with the result that absorption of iRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (see e.g., Malmsten, M. Surfactants and polymers in drug delivery, Informa Health Care, New York, NY, 2002; Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, C1-20 alkyl esters thereof (e.g., methyl, isopropyl and t-butyl), and mono- and di-glycerides thereof (i.e., oleate, laurate, caprate, myristate, palmitate, stearate, linoleate, etc.) (see e.g., Touitou, E., et al. Enhancement in Drug Delivery, CRC Press, Danvers, MA, 2006; Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

The physiological role of bile includes the facilitation of dispersion and absorption of lipids and fat-soluble vitamins (see e.g., Malmsten, M. Surfactants and polymers in drug delivery, Informa Health Care, New York, NY, 2002; Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (see e.g., Malmsten, M. Surfactants and polymers in drug delivery, Informa Health Care, New York, NY, 2002; Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating agents, as used in connection with the present invention, can be defined as compounds that remove metallic ions from solution by forming complexes therewith, with the result that absorption of iRNAs through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(see e.g., Katdare, A. et al., Excipient development for pharmaceutical, biotechnology, and drug delivery, CRC Press, Danvers, MA, 2006; Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

As used herein, non-chelating non-surfactant penetration enhancing compounds can be defined as compounds that demonstrate insignificant activity as chelating agents or as surfactants but that nonetheless enhance absorption of iRNAs through the alimentary mucosa (see e.g., Muranishi, Critical Reviews in Therapeutic Drug Carrier Systems, 1990, 7, 1-33). This class of penetration enhancers includes, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of iRNAs at the cellular level can also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs. Examples of commercially available transfection reagents include, for example Lipofectamine™ (Invitrogen; Carlsbad, CA), Lipofectamine 2000™ (Invitrogen; Carlsbad, CA), 293Fectin™ (Invitrogen; Carlsbad, CA), Cellfectin™ (Invitrogen; Carlsbad, CA), DMRIE-C™ (Invitrogen; Carlsbad, CA), FreeStyle™ MAX (Invitrogen; Carlsbad, CA), Lipofectamine™ 2000 CD (Invitrogen; Carlsbad, CA), Lipofectamine™ (Invitrogen; Carlsbad, CA), iRNAMAX (Invitrogen; Carlsbad, CA), Oligofectamine™ (Invitrogen; Carlsbad, CA), Optifect™ (Invitrogen; Carlsbad, CA), X-tremeGENE Q2 Transfection Reagent (Roche; Grenzacherstrasse, Switzerland), DOTAP Liposomal Transfection Reagent (Grenzacherstrasse, Switzerland), DOSPER Liposomal Transfection Reagent (Grenzacherstrasse, Switzerland), or Fugene (Grenzacherstrasse, Switzerland), Transfectam® Reagent (Promega; Madison, WI), TransFast™ Transfection Reagent (Promega; Madison, WI), Tfx™-20 Reagent (Promega; Madison, WI), Tfx™_50 Reagent (Promega; Madison, WI), DreamFect™ (OZ Biosciences; Marseille, France), EcoTransfect (OZ Biosciences; Marseille, France), TransPass$^a$ D1 Transfection Reagent (New England Biolabs; Ipswich, MA, USA), LyoVec™/LipoGen™ (Invitrogen; San Diego, CA, USA), PerFectin Transfection Reagent (Genlantis; San Diego, CA, USA), NeuroPORTER Transfection Reagent (Genlantis; San Diego, CA, USA), GenePORTER Transfection reagent (Genlantis; San Diego, CA, USA), GenePORTER 2 Transfection reagent (Genlantis; San Diego, CA, USA), Cytofectin Transfection Reagent (Genlantis; San Diego, CA, USA), BaculoPORTER Transfection Reagent (Genlantis; San Diego, CA, USA), Trogan-PORTER™ transfection Reagent (Genlantis; San Diego, CA, USA), RiboFect (Bioline; Taunton, MA, USA), PlasFect (Bioline; Taunton, MA, USA), UniFECTOR (B-Bridge International; Mountain View, CA, USA), SureFECTOR (B-Bridge International; Mountain View, CA, USA), or HiFect™ (B-Bridge International, Mountain View, CA, USA), among others.

Other agents can be utilized to enhance the penetration of the administered nucleic acids, including glycols such as ethylene glycol and propylene glycol, pyrrols such as 2-pyrrol, azones, and terpenes such as limonene and menthone.

v. Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

vi. Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids can include sterile and non-sterile aqueous solutions, non-aqueous solutions in common solvents such as alcohols, or solutions of the nucleic acids in liquid or solid oil bases. The solutions can also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

vii. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions can contain substances which increase the viscosity of the suspension including, for example, sodium carboxymethylcellulose, sorbitol and/or dextran. The suspension can also contain stabilizers.

In some embodiments, pharmaceutical compositions featured in the invention include (a) one or more iRNA compounds and (b) one or more agents which function by a non-iRNA mechanism and which are useful in treating a hemolytic disorder. Examples of such agents include, but are not limited to an anti-inflammatory agent, anti-steatosis agent, anti-viral, and/or anti-fibrosis agent.

In addition, other substances commonly used to protect the liver, such as silymarin, can also be used in conjunction with the iRNAs described herein. Other agents useful for treating liver diseases include telbivudine, entecavir, and protease inhibitors such as telaprevir and other disclosed, for example, in Tung et al., U.S. Application Publication Nos. 2005/0148548, 2004/0167116, and 2003/0144217; and in Hale et al., U.S. Application Publication No. 2004/0127488.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured herein in the invention lies generally within a range of circulating concentrations that include the ED50 with little or no toxicity. The dosage can vary within this range depending upon the dosage form employed and the route of administration utilized. For any compound used in the methods featured in the invention, the therapeutically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma can be measured, for example, by high performance liquid chromatography.

In addition to their administration, as discussed above, the iRNAs featured in the invention can be administered in combination with other known agents effective in treatment of pathological processes mediated by contact activation pathway gene expression (i.e., KLKB1 gene expression, F12 gene expression, and/or KNG1 gene expression). In any event, the administering physician can adjust the amount and timing of iRNA administration on the basis of results observed using standard measures of efficacy known in the art or described herein.

VII. Methods for Inhibiting Contact Activation Pathway Gene Expression

The present invention also provides methods of inhibiting expression of a contact activation pathway gene (i.e., a KLKB1 gene, an F12 gene, and/or a KNG1 gene) in a cell.

In one embodiment, the invention provides methods for inhibiting expression of a KLKB1 gene in a cell. The methods include contacting a cell with an RNAi agent, e.g., double stranded RNAi agent, in an amount effective to inhibit expression of KLKB1 in the cell, thereby inhibiting expression of KLKB1 in the cell.

In one embodiment, the invention provides methods for inhibiting expression of an F12 gene in a cell. The methods include contacting a cell with an RNAi agent, e.g., double stranded RNAi agent, in an amount effective to inhibit expression of F12 in the cell, thereby inhibiting expression of F12 in the cell.

In one embodiment, the invention provides methods for inhibiting expression of a KNG1 gene in a cell. The methods include contacting a cell with an RNAi agent, e.g., double stranded RNAi agent, in an amount effective to inhibit expression of KNG1 in the cell, thereby inhibiting expression of KNG1 in the cell.

Contacting of a cell with an RNAi agent, e.g., a double stranded RNAi agent, may be done in vitro or in vivo. Contacting a cell in vivo with the RNAi agent includes contacting a cell or group of cells within a subject, e.g., a human subject, with the RNAi agent. Combinations of in vitro and in vivo methods of contacting a cell are also possible. Contacting a cell may be direct or indirect, as discussed above. Furthermore, contacting a cell may be accomplished via a targeting ligand, including any ligand described herein or known in the art. In preferred embodiments, the targeting ligand is a carbohydrate moiety, e.g., a GalNAc3 ligand, or any other ligand that directs the RNAi agent to a site of interest.

The term "inhibiting," as used herein, is used interchangeably with "reducing," "silencing," "downregulating", "suppressing", and other similar terms, and includes any level of inhibition.

The phrase "inhibiting expression of a contact activation pathway gene" is intended to refer to inhibition of expression of any contact activation pathway gene (such as, e.g., a mouse contact activation pathway gene, a rat contact activation pathway gene, a monkey contact activation pathway gene, or a human contact activation pathway gene) as well as variants or mutants of a contact activation pathway gene.

The phrase "inhibiting expression of a KLKB1" is intended to refer to inhibition of expression of any KLKB1 gene (such as, e.g., a mouse KLKB1 gene, a rat KLKB1 gene, a monkey KLKB1 gene, or a human KLKB1 gene) as well as variants or mutants of a KLKB1 gene. Thus, the KLKB1 gene may be a wild-type KLKB1 gene, a mutant KLKB1 gene (such as a mutant KLKB1 gene giving rise to amyloid deposition), or a transgenic KLKB1 gene in the context of a genetically manipulated cell, group of cells, or organism.

"Inhibiting expression of a KLKB1 gene" includes any level of inhibition of a KLKB1 gene, e.g., at least partial suppression of the expression of a KLKB1 gene. The expression of the KLKB1 gene may be assessed based on the level, or the change in the level, of any variable associated with KLKB1 gene expression, e.g., KLKB1 mRNA level, KLKB1 protein level, or the number or extent of amyloid deposits. This level may be assessed in an individual cell or in a group of cells, including, for example, a sample derived from a subject.

The phrase "inhibiting expression of F12" is intended to refer to inhibition of expression of any F12 gene (such as, e.g., a mouse F12 gene, a rat F12 gene, a monkey F12 gene, or a human F12 gene) as well as variants or mutants of an F12 gene. Thus, the F12 gene may be a wild-type F12 gene, a mutant F12 gene (such as a mutant F12 gene), or a transgenic F12 gene in the context of a genetically manipulated cell, group of cells, or organism.

"Inhibiting expression of an F12 gene" includes any level of inhibition of an F12 gene, e.g., at least partial suppression of the expression of an F12 gene. The expression of the F12 gene may be assessed based on the level, or the change in the level, of any variable associated with F12 gene expression, e.g., F12 mRNA level, F12 protein level, or the number or extent of amyloid deposits. This level may be assessed in an individual cell or in a group of cells, including, for example, a sample derived from a subject.

The phrase "inhibiting expression of KNG1" is intended to refer to inhibition of expression of any KNG1 gene (such as, e.g., a mouse KNG1 gene, a rat KNG1 gene, a monkey KNG1 gene, or a human KNG1 gene) as well as variants or mutants of an KNG1 gene. Thus, the KNG1 gene may be a wild-type KNG1 gene, a mutant KNG1 gene (such as a mutant KNG1 gene), or a transgenic KNG1 gene in the context of a genetically manipulated cell, group of cells, or organism.

"Inhibiting expression of an KNG1 gene" includes any level of inhibition of an KNG1 gene, e.g., at least partial suppression of the expression of an KNG1 gene. The expression of the KNG1 gene may be assessed based on the level, or the change in the level, of any variable associated with KNG1 gene expression, e.g., KNG1 mRNA level, KNG1 protein level, or the number or extent of amyloid deposits. This level may be assessed in an individual cell or in a group of cells, including, for example, a sample derived from a subject.

Inhibition may be assessed by a decrease in an absolute or relative level of one or more variables that are associated with contact activation pathway gene expression compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In some embodiments of the methods of the invention, expression of a contact activation pathway gene (i.e., a KLKB1 gene, an F12 gene, and/or a KNG1 gene) is inhibited by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%. at least about 95%, at least about 96%, at least about 97%, at least about 98%, or at least about 99%.

Inhibition of the expression of a contact activation pathway gene may be manifested by a reduction of the amount of mRNA expressed by a first cell or group of cells (such cells may be present, for example, in a sample derived from a subject) in which a contact activation pathway gene is transcribed and which has or have been treated (e.g., by contacting the cell or cells with an RNAi agent of the invention, or by administering an RNAi agent of the invention to a subject in which the cells are or were present) such that the expression of a contact activation pathway gene is inhibited, as compared to a second cell or group of cells substantially identical to the first cell or group of cells but which has not or have not been so treated (control cell(s)). In preferred embodiments, the inhibition is assessed by expressing the level of mRNA in treated cells as a percentage of the level of mRNA in control cells, using the following formula:

$$\frac{(mRNA \text{ in control cells}) - (mRNA \text{ in treated cells})}{(mRNA \text{ in control cells})} \cdot 100\%$$

Alternatively, inhibition of the expression of a contact activation pathway gene may be assessed in terms of a reduction of a parameter that is functionally linked to contact activation pathway gene expression, e.g., KLKB1 protein expression, F12 protein expression, KNG1 protein expression, fibrin deposition, thrombus generation, or bradykinin level. Contact activation pathway gene silencing may be determined in any cell expressing a contact activation pathway gene, either constitutively or by genomic engineering, and by any assay known in the art.

Inhibition of the expression of a contact activation pathway protein may be manifested by a reduction in the level of a contact activation pathway protein that is expressed by a cell or group of cells (e.g., the level of protein expressed in a sample derived from a subject). As explained above, for the assessment of mRNA suppression, the inhibiton of protein expression levels in a treated cell or group of cells may similarly be expressed as a percentage of the level of protein in a control cell or group of cells.

A control cell or group of cells that may be used to assess the inhibition of the expression of a contact activation pathway gene includes a cell or group of cells that has not yet been contacted with an RNAi agent of the invention. For example, the control cell or group of cells may be derived from an individual subject (e.g., a human or animal subject) prior to treatment of the subject with an RNAi agent.

The level of contact activation pathway mRNA that is expressed by a cell or group of cells, or the level of circulating contact activation pathway mRNA, may be determined using any method known in the art for assessing mRNA expression. In one embodiment, the level of expression of a contact activation pathway gene in a sample is determined by detecting a transcribed polynucleotide, or portion thereof, e.g., mRNA of the KLKB1 gene, mRNA of the F12 gene, and/or mRNA of the KNG1 gene. RNA may be extracted from cells using RNA extraction techniques including, for example, using acid phenol/guanidine isothiocyanate extraction (RNAzol B; Biogenesis), RNeasy RNA preparation kits (Qiagen) or PAXgene (PreAnalytix, Switzerland). Typical assay formats utilizing ribonucleic acid hybridization include nuclear run-on assays, RT-PCR, RNase protection assays (Melton et al., Nuc. Acids Res. 12:7035), Northern blotting, in situ hybridization, and microarray analysis. Circulating KLKB1 mRNA may be detected using methods the described in PCT/US2012/043584, the entire contents of which are hereby incorporated herein by reference.

In one embodiment, the level of expression of a contact activation pathway gene is determined using a nucleic acid probe. The term "probe", as used herein, refers to any molecule that is capable of selectively binding to a specific contact activation pathway gene. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or Northern analyses, polymerase chain reaction (PCR) analyses and probe arrays. One method for the determination of mRNA levels involves contacting the isolated mRNA with a nucleic acid molecule (probe) that can hybridize to KLKB1 mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix gene chip array. A skilled artisan can readily adapt known mRNA detection methods for use in determining the level of contact activation pathway gene mRNA.

An alternative method for determining the level of expression of a contact activation pathway gene in a sample involves the process of nucleic acid amplification and/or reverse transcriptase (to prepare cDNA) of for example mRNA in the sample, e.g., by RT-PCR (the experimental embodiment set forth in Mullis, 1987, U.S. Pat. No. 4,683, 202), ligase chain reaction (Barany (1991) Proc. Natl. Acad. Sci. USA 88:189-193), self sustained sequence replication (Guatelli et al. (1990) Proc. Natl. Acad. Sci. USA 87:1874-1878), transcriptional amplification system (Kwoh et al. (1989) Proc. Natl. Acad. Sci. USA 86:1173-1177), Q-Beta Replicase (Lizardi et al. (1988) Bio/Technology 6:1197), rolling circle replication (Lizardi et al., U.S. Pat. No. 5,854, 033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, the level of expression of a contact activation pathway gene is determined by quantitative fluorogenic RT-PCR (i.e., the TaqMan™ System).

The expression levels of a contact activation pathway mRNA may be monitored using a membrane blot (such as used in hybridization analysis such as Northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of KLKB1 expression level may also comprise using nucleic acid probes in solution.

In preferred embodiments, the level of mRNA expression is assessed using branched DNA (bDNA) assays or real time PCR (qPCR). The use of these methods is described and exemplified in the Examples presented herein.

The level of contact activation pathway protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, Western blotting, radioimmunoassay (RIA), enzyme-linked immunosorbent assays (ELISAs), immunofluorescent assays, electrochemiluminescence assays, and the like.

In some embodiments, the efficacy of the methods of the invention can be monitored by detecting or monitoring a reduction in a symptom of a contact activation pathway-associated disease, such as reduction in edema swelling of the extremities, face, larynx, upper respiratory tract, abdomen, trunk, and genitals, prodrome; laryngeal swelling; nonpruritic rash; nausea; vomiting; or abdominal pain. These symptoms may be assessed in vitro or in vivo using any method known in the art.

The term "sample" as used herein refers to a collection of similar fluids, cells, or tissues isolated from a subject, as well as fluids, cells, or tissues present within a subject. Examples of biological fluids include blood, serum and serosal fluids, plasma, lymph, urine, cerebrospinal fluid, saliva, ocular fluids, and the like. Tissue samples may include samples from tissues, organs or localized regions. For example, samples may be derived from particular organs, parts of organs, or fluids or cells within those organisms. In certain embodiments, samples may be derived from the liver (e.g., whole liver or certain segments of liver or certain types of cells in the liver, such as, e.g., hepatocytes), the retina or parts of the retina (e.g., retinal pigment epithelium), the central nervous system or parts of the central nervous system (e.g., ventricles or choroid plexus), or the pancreas or certain cells or parts of the pancreas. In preferred embodiments, a "sample derived from a subject" refers to blood or plasma drawn from the subject. In further embodiments, a "sample derived from a subject" refers to liver tissue or retinal tissue derived from the subject.

In some embodiments of the methods of the invention, the RNAi agent is administered to a subject such that the RNAi agent is delivered to a specific site within the subject. The inhibition of expression of a contact activation pathway gene may be assessed using measurements of the level or change in the level of contact activation pathway gene mRNA or contact activation pathway protein in a sample derived from fluid or tissue from the specific site within the subject. In preferred embodiments, the site is selected from the group consisting of liver, choroid plexus, retina, and pancreas. The site may also be a subsection or subgroup of cells from any one of the aforementioned sites. The site may also include cells that express a particular type of receptor.

VIII. Methods of Treating or Preventing Contact Activation Pathway-Associated Diseases The present invention provides therapeutic and prophylactic methods which include administering to a subject having a contact activation pathway gene-associated disease, disorder, and/or condition, or prone to developing, a contact activation pathway gene-associated disease, disorder, and/or condition, compositions comprising an iRNA agent (i.e., an iRNA agent targeting a KLKB1 gene, an iRNA agent targeting an F12 gene, an iRNA agent targeting a KNG1 gene, or a combination of any of the foregoing, i.e., a combination of an iRNA agent targeting a KLKB1 gene and an iRNA agent targeting an F12 gene, or a combination of an iRNA agent targeting a KLKB1 gene and an iRNA agent targeting a KNG1 gene, or a combination of an iRNA agent targeting an F12 gene and an iRNA agent targeting a KNG1 gene, or a combination of an iRNA agent targeting a KLKB1 gene, an iRNA agent targeting an F12 gene, and an iRNA agent targeting a KNG1 gene), or pharmaceutical compositions comprising an iRNA agent (i.e., an iRNA agent targeting a KLKB1 gene, an iRNA agent targeting an F12 gene, an iRNA agent targeting a KNG1 gene, or a combination of any of the foregoing), or vectors comprising an iRNA (i.e., an iRNA agent targeting a KLKB1 gene, an iRNA agent targeting an F12 gene, an iRNA agent targeting a KNG1 gene, or a combination of any of the foregoing) of the invention. Non-limiting examples of contact activation pathway gene-associated diseases include, for example, a thrombophilia, heredity angioedema (HAE) (such as hereditary angioedema type I; hereditary angioedema type II; hereditary angioedema type III; or any other hereditary angioedema caused by elevated levels of bradykinin), prekallikrein deficiency, malignant essential hypertension, hypertension, end stage renal disease, Fletcher Factor Deficiency, edema swelling of the extremities, face, larynx, upper respiratory tract, abdomen, trunk, and genitals, prodrome; laryngeal swelling; nonpruritic rash; nausea; vomiting; abdominal pain.

In one embodiment, the contact activation pathway gene-associated disease is a thrombophilia. In another embodiment, the contact activation pathway gene-associated disease is HAE. In another embodiment, the contact activation pathway gene-associated disease is prekallikrein deficiency. In another embodiment, the contact activation pathway gene-associated disease is malignant essential hypertension. In another embodiment, the contact activation pathway gene-associated disease is hypertension. In another embodiment, the contact activation pathway gene-associated disease is end stage renal disease. In another embodiment, the contact activation pathway gene-associated disease is Fletcher Factor Deficiency.

The methods of the invention are useful for treating a subject having a contact activation pathway gene-associated disease, e.g., a subject that would benefit from reduction in contact activation pathway gene expression and/or contact activation pathway protein production. In one aspect, the present invention provides methods of reducing the level of Kallikrein B, Plasma (Fletcher Factor) 1 (KLKB1) gene expression in a subject having hereditary angioedema (HAE). In another aspect, the present invention provides methods of reducing the level of KLKB1 protein in a subject with HAE. In one aspect, the present invention provides methods of reducing the level of Factor XII (Hageman Factor) (F12) gene expression in a subject having hereditary angioedema (HAE). In another aspect, the present invention provides methods of reducing the level of F12 protein in a subject with HAE. In one aspect, the present invention provides methods of reducing the level of Kininogen 1 (KNG1) gene expression in a subject having hereditary angioedema (HAE). In another aspect, the present invention provides methods of reducing the level of KNG1 protein in a subject with HAE.

The present invention also provides methods of reducing the level of bradykinin in a subject with contact activation pathway-associated disease, e.g., a thrombophilia or hereditary angioedema. For example, in one embodiment, the invention provides methods of reducing the level of bradykinin in a subject with hereditary angioedema which include administering to the subject a therapeutically effective amount or a prophylactically effective amount of a dsRNA agent of the invention, (i.e., an iRNA agent targeting a KLKB1 gene, an iRNA agent targeting an F12 gene, an iRNA agent targeting a KNG1 gene, or a combination of any of the foregoing, i.e., a combination of an iRNA agent targeting a KLKB1 gene and an iRNA agent targeting an F12 gene, or a combination of an iRNA agent targeting a KLKB1 gene and an iRNA agent targeting a KNG1 gene, or a combination of an iRNA agent targeting an F12 gene and an iRNA agent targeting a KNG1 gene, or a combination of an iRNA agent targeting a KLKB1 gene, an iRNA agent targeting an F12 gene, and an iRNA agent targeting a KNG1 gene), or a pharmaceutical composition or vector comprising such agents, or combinations of such agents.

In one aspect, the present invention provides methods of treating a subject having an contact activation pathway-associated disease, e.g., a thrombophilia, hereditary angioedema type I; hereditary angioedema type II; hereditary angioedema type III; any other hereditary angioedema caused by elevated levels of bradykinin. In one embodiment, the treatment methods (and uses) of the invention include administering to the subject, e.g., a human, a therapeutically effective amount of an iRNA agent of the invention targeting a KLKB1 gene or a pharmaceutical composition comprising an iRNA agent of the invention targeting a KLKB1 gene or a vector of the invention comprising an iRNA agent targeting an KLKB1 gene. In another embodiment, the treatment methods (and uses) of the invention include administering to the subject, e.g., a human, a therapeutically effective amount of an iRNA agent of the invention targeting an F12 gene or a pharmaceutical composition comprising an iRNA agent of the invention targeting an F12 gene or a vector of the invention comprising an iRNA agent targeting an F12 gene. In yet another embodiment, the treatment methods (and uses) of the invention include administering to the subject, e.g., a human, a therapeutically effective amount of an iRNA agent of the invention targeting an KNG1 gene or a pharmaceutical composition comprising an iRNA agent of the invention targeting an KNG1 gene or a vector of the invention comprising an iRNA agent targeting an KNG1 gene. In other embodiments, the treatment methods (and uses) of the invention include administering to the subject, e.g., a human, a therapeutically effective amount of a combination of dsRNA agents of the invention, (i.e., a combination of an iRNA agent targeting a KLKB1 gene and an iRNA agent targeting an F12 gene, or a combination of an iRNA agent targeting a KLKB1 gene and an iRNA agent targeting a KNG1 gene, or a combination of an iRNA agent targeting an F12 gene and an iRNA agent targeting a KNG1 gene, or a combination of an iRNA agent targeting a KLKB1 gene, an iRNA agent targeting an F12 gene, and an iRNA agent targeting a KNG1 gene), or a pharmaceutical composition or vector comprising such agents, or combinations of such agents.

In another aspect, the present invention provides methods of treating a subject having HAE. In one embodiment, the methods (and uses) of the invention for treating a subject having HAE include administering to the subject, e.g., a human, a therapeutically effective amount of an iRNA agent of the invention targeting a F12 gene or a pharmaceutical composition comprising an iRNA agent of the invention targeting a F12 gene or a vector of the invention comprising an iRNA agent targeting an F12 gene. In another embodiment, the methods (and uses) of the invention for treating a subject having HAE include administering to the subject, e.g., a human, a therapeutically effective amount of an iRNA agent of the invention targeting an KLKB1 gene or a pharmaceutical composition comprising an iRNA agent of the invention targeting an KLKB1 gene or a vector of the invention comprising an iRNA agent targeting an KLKB1 gene. In yet another embodiment, the methods (and uses) of the invention for treating a subject having HAE include administering to the subject, e.g., a human, a therapeutically effective amount of an iRNA agent of the invention targeting an KNG1 gene or a pharmaceutical composition comprising an iRNA agent of the invention targeting an KNG1 gene or a vector of the invention comprising an iRNA agent targeting an KNG1 gene. In other embodiments, the methods (and uses) of the invention for treating a subject having HAE include administering to the subject, e.g., a human, a therapeutically effective amount of a combination of dsRNA agents of the invention, (i.e., a combination of an iRNA agent targeting a KLKB1 gene and an iRNA agent targeting an F12 gene, or a combination of an iRNA agent targeting a KLKB1 gene and an iRNA agent targeting a KNG1 gene, or a combination of an iRNA agent targeting an F12 gene and an iRNA agent targeting a KNG1 gene, or a combination of an iRNA agent targeting a KLKB1 gene, an iRNA agent targeting an F12 gene, and an iRNA agent targeting a KNG1 gene), or a pharmaceutical composition or vector comprising such agents, or combinations of such agents.

In another aspect, the present invention provides methods of treating a subject having a thrombophilia. In one embodiment, the methods (and uses) of the invention for treating a subject having thrombophilia include administering to the subject, e.g., a human, a therapeutically effective amount of an iRNA agent of the invention targeting a F12 gene or a pharmaceutical composition comprising an iRNA agent of the invention targeting a F12 gene or a vector of the invention comprising an iRNA agent targeting an F12 gene. In another embodiment, the methods (and uses) of the invention for treating a subject having thrombophilia include administering to the subject, e.g., a human, a therapeutically effective amount of an iRNA agent of the invention targeting an KLKB1 gene or a pharmaceutical composition comprising an iRNA agent of the invention targeting an KLKB1 gene or a vector of the invention comprising an iRNA agent targeting an KLKB1 gene. In yet another embodiment, the methods (and uses) of the invention for treating a subject having thrombophilia include administering to the subject, e.g., a human, a therapeutically effective amount of an iRNA agent of the invention targeting an KNG1 gene or a pharmaceutical composition comprising an iRNA agent of the invention targeting an KNG1 gene or a vector of the invention comprising an iRNA agent targeting an KNG1 gene. In other embodiments, the methods (and uses) of the invention for treating a subject having thrombophilia include administering to the subject, e.g., a human, a therapeutically effective amount of a combination of dsRNA agents of the invention, (i.e., a combination of an iRNA agent targeting a KLKB1 gene and an iRNA agent targeting an F12 gene, or a combination of an iRNA agent targeting a KLKB1 gene and an iRNA agent targeting a KNG1 gene, or a combination of an iRNA agent targeting an F12 gene and an iRNA agent targeting a KNG1 gene, or a combination of an iRNA agent targeting a KLKB1 gene, an iRNA agent targeting an F12 gene, and an iRNA agent targeting a KNG1 gene), or a pharmaceutical composition or vector comprising such agents, or combinations of such agents.

In one aspect, the invention provides methods of preventing at least one symptom in a subject having a contact activation pathway-associated disease, e.g., a thrombophilia, hereditary angioedema (HAE), e.g., the presence of elevated bradykinin, edema swelling of the extremities, face, larynx, upper respiratory tract, abdomen, trunk, and genitals, prodrome; laryngeal swelling; nonpruritic rash; nausea; vomiting; abdominal pain. The methods include administering to the subject a prophylactically effective amount of the iRNA agent, e.g. dsRNA, pharmaceutical compositions, or vectors of the invention, thereby preventing at least one symptom in a subject having a contact activation pathway-associated disease. In one embodiment, the prophylactic methods (and uses) of the invention include administering to the subject, e.g., a human, a prophylactically effective amount of an iRNA agent of the invention targeting a KLKB1 gene or a pharmaceutical composition comprising an iRNA agent of the invention targeting a KLKB1 gene or a vector of the invention comprising an iRNA agent targeting an KLKB1 gene. In another embodiment, the prophylactic methods (and uses) of the invention include administering to the subject, e.g., a human, a prophylactically effective amount of an iRNA agent of the invention targeting an F12 gene or a pharmaceutical composition comprising an iRNA agent of the invention targeting an F12 gene or a vector of the invention comprising an iRNA agent targeting an F12 gene. In yet another embodiment, the prophylactic methods (and uses) of the invention include administering to the subject, e.g., a human, a prophylactically effective amount of an iRNA agent of the invention targeting an KNG1 gene or a pharmaceutical composition comprising an iRNA agent of the invention targeting an KNG1 gene or a vector of the invention comprising an iRNA agent targeting an KNG1 gene. In other embodiments, the prophylactic methods (and uses) of the invention include administering to the subject, e.g., a human, a prophylactically effective amount of a combination of dsRNA agents of the invention, (i.e., a combination of an iRNA agent targeting a KLKB1 gene and an iRNA agent targeting an F12 gene, or a combination of an iRNA agent targeting a KLKB1 gene and an iRNA agent targeting a KNG1 gene, or a combination of an iRNA agent targeting an F12 gene and an iRNA agent targeting a KNG1 gene, or a combination of an iRNA agent targeting a KLKB1 gene, an iRNA agent targeting an F12 gene, and an iRNA agent targeting a KNG1 gene), or a pharmaceutical composition or vector comprising such agents, or combinations of such agents.

In one aspect, the present invention provides methods of preventing the formation of a thrombus in a subject at risk of forming a thrombus. The methods include administering to the subject a prophylactically effective amount of the iRNA agent, e.g. dsRNA, pharmaceutical compositions, or vectors of the invention, thereby preventing the formation of a thrombus in the subject at risk of forming a thrombus. In one embodiment, the prophylactic methods (and uses) of the invention include administering to the subject, e.g., a human, a prophylactically effective amount of an iRNA agent of the invention targeting a KLKB1 gene or a pharmaceutical composition comprising an iRNA agent of the invention targeting a KLKB1 gene or a vector of the invention comprising an iRNA agent targeting an KLKB1 gene. In another embodiment, the prophylactic methods (and uses) of the invention include administering to the subject, e.g., a human, a prophylactically effective amount of an iRNA agent of the invention targeting an F12 gene or a pharmaceutical composition comprising an iRNA agent of the invention targeting an F12 gene or a vector of the invention comprising an iRNA agent targeting an F12 gene. In yet another embodiment, the prophylactic methods (and uses) of the invention include administering to the subject, e.g., a human, a prophylactically effective amount of an iRNA agent of the invention targeting an KNG1 gene or a pharmaceutical composition comprising an iRNA agent of the invention targeting an KNG1 gene or a vector of the invention comprising an iRNA agent targeting an KNG1 gene. In other embodiments, the prophylactic methods (and uses) of the invention include administering to the subject, e.g., a human, a prophylactically effective amount of a combination of dsRNA agents of the invention, (i.e., a combination of an iRNA agent targeting a KLKB1 gene and an iRNA agent targeting an F12 gene, or a combination of an iRNA agent targeting a KLKB1 gene and an iRNA agent targeting a KNG1 gene, or a combination of an iRNA agent targeting an F12 gene and an iRNA agent targeting a KNG1 gene, or a combination of an iRNA agent targeting a KLKB1 gene, an iRNA agent targeting an F12 gene, and an iRNA agent targeting a KNG1 gene), or a pharmaceutical composition or vector comprising such agents, or combinations of such agents.

"Subjects at risk of forming a thrombus" include surgical patients (e.g., subjects having general surgery, dental surgery, orthopedic surgery (e.g., knee or hip replacement surgery), trauma surgery, oncological surgery); medical patients (e.g., subjects having an immobilizing disease, e.g., subjects having more than three days of bed rest and/or subjects having long-term use of an intravenous catheter; subjects having atrial fibrillation; elderly subjects; subjects having renal impairment; subjects having a prosthetic heart valve; subjects having heart failure; subjects having cancer); pregnant subjects; postpartum subjects; subjects that have previously had a thrombus; subjects undergoing hormone replacement therapy; subjects sitting for long periods of time, such as in a plane or car; and obese subjects.

In one aspect, the present invention provides methods of preventing an angioedema attack in a subject having HAE. The methods include administering to the subject a prophylactically effective amount of the iRNA agent, e.g. dsRNA, pharmaceutical compositions, or vectors of the invention, thereby preventing the formation of a thrombus in the subject at risk of forming a thrombus. In one embodiment, the prophylactic methods (and uses) of the invention include administering to the subject, e.g., a human, a prophylactically effective amount of an iRNA agent of the invention targeting a KLKB1 gene or a pharmaceutical composition comprising an iRNA agent of the invention targeting a KLKB1 gene or a vector of the invention comprising an iRNA agent targeting an KLKB1 gene. In another embodiment, the prophylactic methods (and uses) of the invention include administering to the subject, e.g., a human, a prophylactically effective amount of an iRNA agent of the invention targeting an F12 gene or a pharmaceutical composition comprising an iRNA agent of the invention targeting an F12 gene or a vector of the invention comprising an iRNA agent targeting an F12 gene. In yet another embodiment, the prophylactic methods (and uses) of the invention include administering to the subject, e.g., a human, a prophylactically effective amount of an iRNA agent of the invention targeting an KNG1 gene or a pharmaceutical composition comprising an iRNA agent of the invention targeting an KNG1 gene or a vector of the invention comprising an iRNA agent targeting an KNG1 gene. In other embodiments, the prophylactic methods (and uses) of the invention include administering to the subject, e.g., a human, a prophylactically effective amount of a combination of dsRNA agents of the invention, (i.e., a combination of an iRNA agent targeting a KLKB1 gene and an iRNA agent targeting an F12 gene, or a combination of an iRNA agent targeting a KLKB1 gene and an iRNA agent targeting a KNG1 gene, or a combination of an iRNA agent targeting an F12 gene and an iRNA agent targeting a KNG1 gene, or a combination of an iRNA agent targeting a KLKB1 gene, an iRNA agent targeting an F12 gene, and an iRNA agent targeting a KNG1 gene), or a pharmaceutical composition or vector comprising such agents, or combinations of such agents.

In one aspect, the present invention provides uses of a therapeutically effective amount of an iRNA agent of the invention for treating a subject, e.g., a subject that would benefit from a reduction and/or inhibition of KLKB1 gene expression.

In another aspect, the present invention provides uses of a therapeutically effective amount of an iRNA agent of the invention for treating a subject, e.g., a subject that would benefit from a reduction and/or inhibition of F12 gene expression.

In yet another aspect, the present invention provides uses of a therapeutically effective amount of an iRNA agent of the invention for treating a subject, e.g., a subject that would benefit from a reduction and/or inhibition of KNG1 gene expression.

In another aspect, the present invention provides uses of an iRNA agent, e.g., a dsRNA, of the invention targeting an KLKB1 gene or pharmaceutical composition comprising an iRNA agent targeting a KLKB1 gene in the manufacture of a medicament for treating a subject, e.g., a subject that would benefit from a reduction and/or inhibition of KLKB1 gene expression and/or KLKB1 protein production, such as a subject having a disorder that would benefit from reduction in KLKB1 gene expression, e.g., a contact activation pathway-associated disease.

In one aspect, the present invention provides uses of an iRNA agent, e.g., a dsRNA, of the invention targeting an F12 gene or pharmaceutical composition comprising an iRNA agent targeting an F12 gene in the manufacture of a medicament for treating a subject, e.g., a subject that would benefit from a reduction and/or inhibition of F12 gene expression and/or F12 protein production, such as a subject having a disorder that would benefit from reduction in F12 gene expression, e.g., a contact activation pathway-associated disease.

In another aspect, the present invention provides uses of an iRNA agent, e.g., a dsRNA, of the invention targeting an KNG1 gene or pharmaceutical composition comprising an iRNA agent targeting a KNG1 gene in the manufacture of a medicament for treating a subject, e.g., a subject that would benefit from a reduction and/or inhibition of KNG1 gene expression and/or KNG1 protein production, such as a subject having a disorder that would benefit from reduction in KNG1 gene expression, e.g., a contact activation pathway-associated disease.

In another aspect, the invention provides uses of an iRNA, e.g., a dsRNA, of the invention for preventing at least one symptom in a subject suffering from a disorder that would benefit from a reduction and/or inhibition of KLKB1 gene expression and/or KLKB1 protein production.

In another aspect, the invention provides uses of an iRNA, e.g., a dsRNA, of the invention for preventing at least one symptom in a subject suffering from a disorder that would benefit from a reduction and/or inhibition of F12 gene expression and/or F12 protein production.

In another aspect, the invention provides uses of an iRNA, e.g., a dsRNA, of the invention for preventing at least one symptom in a subject suffering from a disorder that would benefit from a reduction and/or inhibition of KNG1 gene expression and/or KNG1 protein production.

In a further aspect, the present invention provides uses of an iRNA agent of the invention in the manufacture of a medicament for preventing at least one symptom in a subject suffering from a disorder that would benefit from a reduction and/or inhibition of KLKB1 gene expression and/or KLKB1 protein production, such as a contact activation pathway-associated disease.

In one embodiment, an iRNA agent targeting KLKB1 is administered to a subject having hereditary angioedema (HAE) and/or an KLKB1-associated disease such that the expression of a KLKB1 gene, e.g., in a cell, tissue, blood or other tissue or fluid of the subject are reduced by at least about 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 62%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least about 99% or more when the dsRNA agent is administered to the subject.

The methods and uses of the invention include administering a composition described herein such that expression of the target KLKB1 gene is decreased, such as for about 1, 2, 3, 4 5, 6, 7, 8, 12, 16, 18, 24, 28, 32, 36, 40, 44, 48, 52, 56, 60, 64, 68, 72, 76, or about 80 hours. In one embodiment, expression of the target KLKB1 gene is decreased for an extended duration, e.g., at least about two, three, four, five, six, seven days or more, e.g., about one week, two weeks, three weeks, or about four weeks or longer.

In a further aspect, the present invention provides uses of an iRNA agent of the invention in the manufacture of a medicament for preventing at least one symptom in a subject suffering from a disorder that would benefit from a reduction and/or inhibition of F12 gene expression and/or F12 protein production, such as a contact activation pathway-associated disease.

In one embodiment, an iRNA agent targeting F12 is administered to a subject having hereditary angioedema (HAE) and/or a contact activation pathway-associated disease such that the expression of a F12 gene, e.g., in a cell, tissue, blood or other tissue or fluid of the subject are reduced by at least about 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 62%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least about 99% or more when the dsRNA agent is administered to the subject.

The methods and uses of the invention include administering a composition described herein such that expression of the target F12 gene is decreased, such as for about 1, 2, 3, 4 5, 6, 7, 8, 12, 16, 18, 24, 28, 32, 36, 40, 44, 48, 52, 56, 60, 64, 68, 72, 76, or about 80 hours. In one embodiment, expression of the target F12 gene is decreased for an extended duration, e.g., at least about two, three, four, five, six, seven days or more, e.g., about one week, two weeks, three weeks, or about four weeks or longer.

In a further aspect, the present invention provides uses of an iRNA agent of the invention in the manufacture of a medicament for preventing at least one symptom in a subject suffering from a disorder that would benefit from a reduction and/or inhibition of KNG1 gene expression and/or KNG1 protein production, such as a contact activation pathway-associated disease.

In one embodiment, an iRNA agent targeting KNG1 is administered to a subject having hereditary angioedema (HAE) and/or a contact activation pathway-associated disease such that the expression of a KNG1 gene, e.g., in a cell, tissue, blood or other tissue or fluid of the subject are reduced by at least about 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 62%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least about 99% or more when the dsRNA agent is administered to the subject.

The methods and uses of the invention include administering a composition described herein such that expression of the target KNG1 gene is decreased, such as for about 1, 2, 3, 4 5, 6, 7, 8, 12, 16, 18, 24, 28, 32, 36, 40, 44, 48, 52, 56, 60, 64, 68, 72, 76, or about 80 hours. In one embodiment, expression of the target KNG1 gene is decreased for an extended duration, e.g., at least about two, three, four, five, six, seven days or more, e.g., about one week, two weeks, three weeks, or about four weeks or longer.

Administration of the dsRNA according to the methods and uses of the invention may result in a reduction of the severity, signs, symptoms, and/or markers of such diseases or disorders in a patient with hereditary angioedema (HAE) and/or contact activation pathway-associated disease. By "reduction" in this context is meant a statistically significant decrease in such level. The reduction can be, for example, at least about 5%, 10%, 15%, 20%, 25%, 30%, 35%, 40%, 45%, 50%, 55%, 60%, 65%, 70%, 75%, 80%, 85%, 90%, 95%, or about 100%.

Efficacy of treatment or prevention of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. For example, efficacy of treatment of HAE may be assessed, for example, by periodic monitoring of HAE symptoms or bradykinin levels. Comparison of the later readings with the initial readings provide a physician an indication of whether the treatment is effective. It is well within the ability of one skilled in the art to monitor efficacy of treatment or prevention by measuring any one of such parameters, or any combination of parameters. In connection with the administration of an iRNA targeting a contact activation pathway gene or pharmaceutical composition thereof, "effective against" a contact activation pathway-associated disease indicates that administration in a clinically appropriate manner results in a beneficial effect for at least a statistically significant fraction of patients, such as improvement of symptoms, a cure, a reduction in disease, extension of life, improvement in quality of life, or other effect generally recognized as positive by medical doctors familiar with treating HAE and/or a contact activation pathway-associated disease and the related causes.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given iRNA drug or formulation of that drug can also be judged using an experimental animal model for the given disease as known in the art. When using an experimental animal model, efficacy of treatment is evidenced when a statistically significant reduction in a marker or symptom is observed.

Subjects can be administered a therapeutic amount of iRNA, such as about 0.01 mg/kg, 0.02 mg/kg, 0.03 mg/kg, 0.04 mg/kg, 0.05 mg/kg, 0.1 mg/kg, 0.15 mg/kg, 0.2 mg/kg, 0.25 mg/kg, 0.3 mg/kg, 0.35 mg/kg, 0.4 mg/kg, 0.45 mg/kg, 0.5 mg/kg, 0.55 mg/kg, 0.6 mg/kg, 0.65 mg/kg, 0.7 mg/kg, 0.75 mg/kg, 0.8 mg/kg, 0.85 mg/kg, 0.9 mg/kg, 0.95 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2.0 mg/kg, 2.1 mg/kg, 2.2 mg/kg, 2.3 mg/kg, 2.4 mg/kg, 2.5 mg/kg dsRNA, 2.6 mg/kg dsRNA, 2.7 mg/kg dsRNA, 2.8 mg/kg dsRNA, 2.9 mg/kg dsRNA, 3.0 mg/kg dsRNA, 3.1 mg/kg dsRNA, 3.2 mg/kg dsRNA, 3.3 mg/kg dsRNA, 3.4 mg/kg dsRNA, 3.5 mg/kg dsRNA, 3.6 mg/kg dsRNA, 3.7 mg/kg dsRNA, 3.8 mg/kg dsRNA, 3.9 mg/kg dsRNA, 4.0 mg/kg dsRNA, 4.1 mg/kg dsRNA, 4.2 mg/kg dsRNA, 4.3 mg/kg dsRNA, 4.4 mg/kg dsRNA, 4.5 mg/kg dsRNA, 4.6 mg/kg dsRNA, 4.7 mg/kg dsRNA, 4.8 mg/kg dsRNA, 4.9 mg/kg dsRNA, 5.0 mg/kg dsRNA, 5.1 mg/kg dsRNA, 5.2 mg/kg dsRNA, 5.3 mg/kg dsRNA, 5.4 mg/kg dsRNA, 5.5 mg/kg dsRNA, 5.6 mg/kg dsRNA, 5.7 mg/kg dsRNA, 5.8 mg/kg dsRNA, 5.9 mg/kg dsRNA, 6.0 mg/kg dsRNA, 6.1 mg/kg dsRNA, 6.2 mg/kg dsRNA, 6.3 mg/kg dsRNA, 6.4 mg/kg dsRNA, 6.5 mg/kg dsRNA, 6.6 mg/kg dsRNA, 6.7 mg/kg dsRNA, 6.8 mg/kg dsRNA, 6.9 mg/kg dsRNA, 7.0 mg/kg dsRNA, 7.1 mg/kg dsRNA, 7.2 mg/kg dsRNA, 7.3 mg/kg dsRNA, 7.4 mg/kg dsRNA, 7.5 mg/kg dsRNA, 7.6 mg/kg dsRNA, 7.7 mg/kg dsRNA, 7.8 mg/kg dsRNA, 7.9 mg/kg dsRNA, 8.0 mg/kg dsRNA, 8.1 mg/kg dsRNA, 8.2 mg/kg dsRNA, 8.3 mg/kg dsRNA, 8.4 mg/kg dsRNA, 8.5 mg/kg dsRNA, 8.6 mg/kg dsRNA, 8.7 mg/kg dsRNA, 8.8 mg/kg dsRNA, 8.9 mg/kg dsRNA, 9.0 mg/kg dsRNA, 9.1 mg/kg dsRNA, 9.2 mg/kg dsRNA, 9.3 mg/kg dsRNA, 9.4 mg/kg dsRNA, 9.5 mg/kg dsRNA, 9.6 mg/kg dsRNA, 9.7 mg/kg dsRNA, 9.8 mg/kg dsRNA, 9.9 mg/kg dsRNA, 9.0 mg/kg dsRNA, 10 mg/kg dsRNA, 15 mg/kg dsRNA, 20 mg/kg dsRNA, 25 mg/kg dsRNA, 30 mg/kg dsRNA, 35 mg/kg dsRNA, 40 mg/kg dsRNA, 45 mg/kg dsRNA, or about 50 mg/kg dsRNA. In one embodiment, subjects can be administered 0.5 mg/kg of the dsRNA. Values and ranges intermediate to the recited values are also intended to be part of this invention.

In certain embodiments, for example, when a composition of the invention comprises a dsRNA as described herein and a lipid, subjects can be administered a therapeutic amount of iRNA, such as about 0.01 mg/kg to about 5 mg/kg, about 0.01 mg/kg to about 10 mg/kg, about 0.05 mg/kg to about 5 mg/kg, about 0.05 mg/kg to about 10 mg/kg, about 0.1 mg/kg to about 5 mg/kg, about 0.1 mg/kg to about 10 mg/kg, about 0.2 mg/kg to about 5 mg/kg, about 0.2 mg/kg to about 10 mg/kg, about 0.3 mg/kg to about 5 mg/kg, about 0.3 mg/kg to about 10 mg/kg, about 0.4 mg/kg to about 5 mg/kg, about 0.4 mg/kg to about 10 mg/kg, about 0.5 mg/kg to about 5 mg/kg, about 0.5 mg/kg to about 10 mg/kg, about 1 mg/kg to about 5 mg/kg, about 1 mg/kg to about 10 mg/kg, about 1.5 mg/kg to about 5 mg/kg, about 1.5 mg/kg to about 10 mg/kg, about 2 mg/kg to about 2.5 mg/kg, about 2 mg/kg to about 10 mg/kg, about 3 mg/kg to about 5 mg/kg, about 3 mg/kg to about 10 mg/kg, about 3.5 mg/kg to about 5 mg/kg, about 4 mg/kg to about 5 mg/kg, about 4.5 mg/kg to about 5 mg/kg, about 4 mg/kg to about 10 mg/kg, about 4.5 mg/kg to about 10 mg/kg, about 5 mg/kg to about 10 mg/kg, about 5.5 mg/kg to about 10 mg/kg, about 6 mg/kg to about 10 mg/kg, about 6.5 mg/kg to about 10 mg/kg, about 7 mg/kg to about 10 mg/kg, about 7.5 mg/kg to about 10 mg/kg, about 8 mg/kg to about 10 mg/kg, about 8.5 mg/kg to about 10 mg/kg, about 9 mg/kg to about 10 mg/kg, or about 9.5 mg/kg to about 10 mg/kg. Values and ranges intermediate to the recited values are also intended to be part of this invention.

For example, the dsRNA may be administered at a dose of about 0.1, 0.2, 0.3, 0.4, 0.5, 0.6, 0.7, 0.8, 0.9, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, 7.5, 7.6, 7.7, 7.8, 7.9, 8, 8.1, 8.2, 8.3, 8.4, 8.5, 8.6, 8.7, 8.8, 8.9, 9, 9.1, 9.2, 9.3, 9.4, 9.5, 9.6, 9.7, 9.8, 9.9, or about 10 mg/kg. Values and ranges intermediate to the recited values are also intended to be part of this invention.

In other embodiments, for example, when a composition of the invention comprises a dsRNA as described herein and an N-acetylgalactosamine, subjects can be administered a therapeutic amount of iRNA, such as a dose of about 0.1 to about 50 mg/kg, about 0.25 to about 50 mg/kg, about 0.5 to about 50 mg/kg, about 0.75 to about 50 mg/kg, about 1 to about 50 mg/kg, about 1.5 to about 50 mg/kg, about 2 to about 50 mg/kg, about 2.5 to about 50 mg/kg, about 3 to about 50 mg/kg, about 3.5 to about 50 mg/kg, about 4 to about 50 mg/kg, about 4.5 to about 50 mg/kg, about 5 to about 50 mg/kg, about 7.5 to about 50 mg/kg, about 10 to about 50 mg/kg, about 15 to about 50 mg/kg, about 20 to about 50 mg/kg, about 20 to about 50 mg/kg, about 25 to about 50 mg/kg, about 25 to about 50 mg/kg, about 30 to about 50 mg/kg, about 35 to about 50 mg/kg, about 40 to about 50 mg/kg, about 45 to about 50 mg/kg, about 0.1 to about 45 mg/kg, about 0.25 to about 45 mg/kg, about 0.5 to about 45 mg/kg, about 0.75 to about 45 mg/kg, about 1 to about 45 mg/kg, about 1.5 to about 45 mg/kg, about 2 to about 45 mg/kg, about 2.5 to about 45 mg/kg, about 3 to about 45 mg/kg, about 3.5 to about 45 mg/kg, about 4 to about 45 mg/kg, about 4.5 to about 45 mg/kg, about 5 to about 45 mg/kg, about 7.5 to about 45 mg/kg, about 10 to about 45 mg/kg, about 15 to about 45 mg/kg, about 20 to about 45 mg/kg, about 20 to about 45 mg/kg, about 25 to about 45 mg/kg, about 25 to about 45 mg/kg, about 30 to about 45 mg/kg, about 35 to about 45 mg/kg, about 40 to about 45 mg/kg, about 0.1 to about 40 mg/kg, about 0.25 to about 40 mg/kg, about 0.5 to about 40 mg/kg, about 0.75 to about 40 mg/kg, about 1 to about 40 mg/kg, about 1.5 to about 40 mg/kg, about 2 to about 40 mg/kg, about 2.5 to about 40 mg/kg, about 3 to about 40 mg/kg, about 3.5 to about 40 mg/kg, about 4 to about 40 mg/kg, about 4.5 to about 40 mg/kg, about 5 to about 40 mg/kg, about 7.5 to about 40 mg/kg, about 10 to about 40 mg/kg, about 15 to about 40 mg/kg, about 20 to about 40 mg/kg, about 20 to about 40 mg/kg, about 25 to about 40 mg/kg, about 25 to about 40 mg/kg, about 30 to about 40 mg/kg, about 35 to about 40 mg/kg, about 0.1 to about 30 mg/kg, about 0.25 to about 30 mg/kg, about 0.5 to about 30 mg/kg, about 0.75 to about 30 mg/kg, about 1 to about 30 mg/kg, about 1.5 to about 30 mg/kg, about 2 to about 30 mg/kg, about 2.5 to about 30 mg/kg, about 3 to about 30 mg/kg, about 3.5 to about 30 mg/kg, about 4 to about 30 mg/kg, about 4.5 to about 30 mg/kg, about 5 to about 30 mg/kg, about 7.5 to about 30 mg/kg, about 10 to about 30 mg/kg, about 15 to about 30 mg/kg, about 20 to about 30 mg/kg, about 20 to about 30 mg/kg, about 25 to about 30 mg/kg, about 0.1 to about 20 mg/kg, about 0.25 to about 20 mg/kg, about 0.5 to about 20 mg/kg, about 0.75 to about 20 mg/kg, about 1 to about 20 mg/kg, about 1.5 to about 20 mg/kg, about 2 to about 20 mg/kg, about 2.5 to about 20 mg/kg, about 3 to about 20 mg/kg, about 3.5 to about 20 mg/kg, about 4 to about 20 mg/kg, about 4.5 to about 20 mg/kg, about 5 to about 20 mg/kg, about 7.5 to about 20 mg/kg, about 10 to about 20 mg/kg, or about 15 to about 20 mg/kg. In one embodiment, when a composition of the invention comprises a dsRNA as described herein and an N-acetylgalactosamine, subjects can be administered a therapeutic amount of about 10 to about 30 mg/kg of dsRNA. Values and ranges intermediate to the recited values are also intended to be part of this invention.

For example, subjects can be administered a therapeutic amount of iRNA, such as about 0.1, 0.2, 0.3, 0.4, 0.5, 0.6, 0.7, 0.8, 0.9, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, 7.5, 7.6, 7.7, 7.8, 7.9, 8, 8.1, 8.2, 8.3, 8.4, 8.5, 8.6, 8.7, 8.8, 8.9, 9, 9.1, 9.2, 9.3, 9.4, 9.5, 9.6, 9.7, 9.8, 9.9, 10, 10.5, 11, 11.5, 12, 12.5, 13, 13.5, 14, 14.5, 15, 15.5, 16, 16.5, 17, 17.5, 18, 18.5, 19, 19.5, 20, 20.5, 21, 21.5, 22, 22.5, 23, 23.5, 24, 24.5, 25, 25.5, 26, 26.5, 27, 27.5, 28, 28.5, 29, 29.5, 30, 31, 32, 33, 34, 34, 35, 36, 37, 38, 39, 40, 41, 42, 43, 44, 45, 46, 47, 48, 49, or about 50 mg/kg. Values and ranges intermediate to the recited values are also intended to be part of this invention.

In certain embodiments of the invention, for example, when a double stranded RNAi agent includes a modification (e.g., one or more motifs of three identical modifications on three consecutive nucleotides), including one such motif at or near the cleavage site of the agent, six phosphorothioate linkages, and a ligand, such an agent is administered at a dose of about 0.01 to about 0.5 mg/kg, about 0.01 to about 0.4 mg/kg, about 0.01 to about 0.3 mg/kg, about 0.01 to about 0.2 mg/kg, about 0.01 to about 0.1 mg/kg, about 0.01 mg/kg to about 0.09 mg/kg, about 0.01 mg/kg to about 0.08 mg/kg, about 0.01 mg/kg to about 0.07 mg/kg, about 0.01 mg/kg to about 0.06 mg/kg, about 0.01 mg/kg to about 0.05 mg/kg, about 0.02 to about 0.5 mg/kg, about 0.02 to about 0.4 mg/kg, about 0.02 to about 0.3 mg/kg, about 0.02 to about 0.2 mg/kg, about 0.02 to about 0.1 mg/kg, about 0.02 mg/kg to about 0.09 mg/kg, about 0.02 mg/kg to about 0.08 mg/kg, about 0.02 mg/kg to about 0.07 mg/kg, about 0.02 mg/kg to about 0.06 mg/kg, about 0.02 mg/kg to about 0.05 mg/kg, about 0.03 to about 0.5 mg/kg, about 0.03 to about 0.4 mg/kg, about 0.03 to about 0.3 mg/kg, about 0.03 to about 0.2 mg/kg, about 0.03 to about 0.1 mg/kg, about 0.03 mg/kg to about 0.09 mg/kg, about 0.03 mg/kg to about 0.08 mg/kg, about 0.03 mg/kg to about 0.07 mg/kg, about 0.03 mg/kg to about 0.06 mg/kg, about 0.03 mg/kg to about 0.05 mg/kg, about 0.04 to about 0.5 mg/kg, about 0.04 to about 0.4 mg/kg, about 0.04 to about 0.3 mg/kg, about 0.04 to about 0.2 mg/kg, about 0.04 to about 0.1 mg/kg, about 0.04 mg/kg to about 0.09 mg/kg, about 0.04 mg/kg to about 0.08 mg/kg, about 0.04 mg/kg to about 0.07 mg/kg, about 0.04 mg/kg to about 0.06 mg/kg, about 0.05 to about 0.5 mg/kg, about 0.05 to about 0.4 mg/kg, about 0.05 to about 0.3 mg/kg, about 0.05 to about 0.2 mg/kg, about 0.05 to about 0.1 mg/kg, about 0.05 mg/kg to about 0.09 mg/kg, about 0.05 mg/kg to about 0.08 mg/kg, or about 0.05 mg/kg to about 0.07 mg/kg. Values and ranges intermediate to the foregoing recited values are also intended to be part of this invention, e.g., the RNAi agent may be administered to the subject at a dose of about 0.015 mg/kg to about 0.45 mg/kg.

For example, the RNAi agent, e.g., RNAi agent in a pharmaceutical composition, may be administered at a dose of about 0.01 mg/kg, 0.0125 mg/kg, 0.015 mg/kg, 0.0175 mg/kg, 0.02 mg/kg, 0.0225 mg/kg, 0.025 mg/kg, 0.0275 mg/kg, 0.03 mg/kg, 0.0325 mg/kg, 0.035 mg/kg, 0.0375 mg/kg, 0.04 mg/kg, 0.0425 mg/kg, 0.045 mg/kg, 0.0475 mg/kg, 0.05 mg/kg, 0.0525 mg/kg, 0.055 mg/kg, 0.0575 mg/kg, 0.06 mg/kg, 0.0625 mg/kg, 0.065 mg/kg, 0.0675 mg/kg, 0.07 mg/kg, 0.0725 mg/kg, 0.075 mg/kg, 0.0775 mg/kg, 0.08 mg/kg, 0.0825 mg/kg, 0.085 mg/kg, 0.0875 mg/kg, 0.09 mg/kg, 0.0925 mg/kg, 0.095 mg/kg, 0.0975 mg/kg, 0.1 mg/kg, 0.125 mg/kg, 0.15 mg/kg, 0.175 mg/kg, 0.2 mg/kg, 0.225 mg/kg, 0.25 mg/kg, 0.275 mg/kg, 0.3 mg/kg, 0.325 mg/kg, 0.35 mg/kg, 0.375 mg/kg, 0.4 mg/kg, 0.425 mg/kg, 0.45 mg/kg, 0.475 mg/kg, or about 0.5 mg/kg. Values intermediate to the foregoing recited values are also intended to be part of this invention.

In some embodiments, the RNAi agent is administered as a fixed dose of between about 100 mg to about 900 mg, e.g., between about 100 mg to about 850 mg, between about 100 mg to about 800 mg, between about 100 mg to about 750 mg, between about 100 mg to about 700 mg, between about 100 mg to about 650 mg, between about 100 mg to about 600 mg, between about 100 mg to about 550 mg, between about 100 mg to about 500 mg, between about 200 mg to about 850 mg, between about 200 mg to about 800 mg, between about 200 mg to about 750 mg, between about 200 mg to about 700 mg, between about 200 mg to about 650 mg, between about 200 mg to about 600 mg, between about 200 mg to about 550 mg, between about 200 mg to about 500 mg, between about 300 mg to about 850 mg, between about 300 mg to about 800 mg, between about 300 mg to about 750 mg, between about 300 mg to about 700 mg, between about 300 mg to about 650 mg, between about 300 mg to about 600 mg, between about 300 mg to about 550 mg, between about 300 mg to about 500 mg, between about 400 mg to about 850 mg, between about 400 mg to about 800 mg, between about 400 mg to about 750 mg, between about 400 mg to about 700 mg, between about 400 mg to about 650 mg, between about 400 mg to about 600 mg, between about 400 mg to about 550 mg, or between about 400 mg to about 500 mg.

In some embodiments, the RNAi agent is administered as a fixed dose of about 100 mg, about 125 mg, about 150 mg, about 175 mg, 200 mg, about 225 mg, about 250 mg, about 275 mg, about 300 mg, about 325 mg, about 350 mg, about 375 mg, about 400 mg, about 425 mg, about 450 mg, about 475 mg, about 500 mg, about 525 mg, about 550 mg, about 575 mg, about 600 mg, about 625 mg, about 650 mg, about 675 mg, about 700 mg, about 725 mg, about 750 mg, about 775 mg, about 800 mg, about 825 mg, about 850 mg, about 875 mg, or about 900 mg.

The iRNA can be administered by intravenous infusion over a period of time, such as over a 5, 6, 7, 8, 9, 10, 11, 12, 13, 14, 15, 16, 17, 18, 19, 20, 21, 22, 23, 24, or about a 25 minute period. The administration may be repeated, for example, on a regular basis, such as weekly, biweekly (i.e., every two weeks) for one month, two months, three months, four months or longer. After an initial treatment regimen, the treatments can be administered on a less frequent basis. For example, after administration weekly or biweekly for three months, administration can be repeated once per month, for six months or a year or longer.

Administration of the iRNA can reduce the presence of contact activation pathway protein (i.e., KLKB1 protein, F12 protein, and/or KNG1 protein) and/or bradykinin levels, e.g., in a cell, tissue, blood, urine or other compartment of the patient by at least about 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least about 99% or more.

Before administration of a full dose of the iRNA, patients can be administered a smaller dose, such as a 5% infusion, and monitored for adverse effects, such as an allergic reaction. In another example, the patient can be monitored for unwanted immunostimulatory effects, such as increased cytokine (e.g., TNF-alpha or INF-alpha) levels.

Owing to the inhibitory effects on contact activation pathway gene expression, a composition according to the invention or a pharmaceutical composition prepared therefrom can enhance the quality of life.

An iRNA of the invention may be administered in "naked" form, where the modified or unmodified iRNA agent is directly suspended in aqueous or suitable buffer solvent, as a "free iRNA." A free iRNA is administered in the absence of a pharmaceutical composition. The free iRNA may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the iRNA can be adjusted such that it is suitable for administering to a subject.

Alternatively, an iRNA of the invention may be administered as a pharmaceutical composition, such as a dsRNA liposomal formulation.

Subjects that would benefit from a reduction and/or inhibition of contact activation pathway gene expression are those having hereditary angioedema (HAE) and/or a contact activation pathway-associated disease or disorder as described herein.

Treatment of a subject that would benefit from a reduction and/or inhibition of contact activation pathway gene expression includes therapeutic and prophylactic treatment.

The invention further provides methods and uses of an iRNA agent or a pharmaceutical composition thereof for treating a subject that would benefit from reduction and/or inhibition of contact activation pathway gene expression, e.g., a subject having a contact activation pathway-associated disease, in combination with other pharmaceuticals and/or other therapeutic methods, e.g., with known pharmaceuticals and/or known therapeutic methods, such as, for example, those which are currently employed for treating these disorders.

For example, in certain embodiments, an iRNA targeting a contact activation pathway gene is administered in combination with, e.g., an agent useful in treating an contact activation pathway-associated disease as described elsewhere herein. For example, additional therapeutics and therapeutic methods suitable for treating a subject that would benefit from reduction in contact activation pathway gene expression, e.g., a subject having a contact activation pathway-associated disease, include an iRNA agent targeting a different portion of the contact activation pathway gene, an androgen, or a therapeutic agent, e.g., a C1INH replacement protein, a kallikrein inhibitor peptide, a bradykinin B2 receptor antagonist peptide, or other therapeutic agents and/or procedures for treating a contact activation pathway-associated disease or a combination of any of the foregoing. In one embodiment, the additional therapeutic is selected from the group consisting of an androgen, such as danazol or oxandrolone, Berinert®, Cinryze™, Rhuconest®, Ecallantide, Firazyr®, Kalbitor®, and a combination of any of the foregoing.

In certain embodiments, a first iRNA agent targeting a contact activation pathway gene is administered in combination with a second iRNA agent targeting a different portion of the contact activation pathway gene. For example, the first RNAi agent comprises a first sense strand and a first antisense strand forming a double stranded region, wherein substantially all of the nucleotides of said first sense strand and substantially all of the nucleotides of the first antisense strand are modified nucleotides, wherein said first sense strand is conjugated to a ligand attached at the 3'-terminus, and wherein the ligand is one or more GalNAc derivatives attached through a bivalent or trivalent branched linker; and the second RNAi agent comprises a second sense strand and a second antisense strand forming a double stranded region, wherein substantially all of the nucleotides of the second sense strand and substantially all of the nucleotides of the second antisense strand are modified nucleotides, wherein the second sense strand is conjugated to a ligand attached at the 3'-terminus, and wherein the ligand is one or more GalNAc derivatives attached through a bivalent or trivalent branched linker.

In one embodiment, all of the nucleotides of the first and second sense strand and/or all of the nucleotides of the first and second antisense strand comprise a modification.

In one embodiment, the at least one of the modified nucleotides is selected from the group consisting of a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, and a nucleotide comprising a 5'-phosphate mimic.

In certain embodiments, a first iRNA agent targeting a contact activation pathway gene is administered in combination with a second iRNA agent targeting a gene that is different from the contact activation pathway gene. For example, the iRNA agent targeting the KLKB1 gene may be administered in combination with an iRNA agent targeting the coagulation factor XII (F12) gene. The first iRNA agent targeting a KLKB1 gene and the second iRNA agent targeting a gene different from the KLKB1 gene, e.g., the coagulation factor XII (F12) gene, may be administered as parts of the same pharmaceutical composition. Alternatively, the first iRNA agent targeting a KLKB1 gene and the second iRNA agent targeting a gene different from the KLKB1 gene, e.g., the coagulation factor XII (F12) gene, may be administered as parts of different pharmaceutical compositions.

The iRNA agent and an additional therapeutic agent and/or treatment may be administered at the same time and/or in the same combination, e.g., parenterally, or the additional therapeutic agent can be administered as part of a separate composition or at separate times and/or by another method known in the art or described herein.

The present invention also provides methods of using an iRNA agent of the invention and/or a composition containing an iRNA agent of the invention to reduce and/or inhibit contact activation pathway gene expression (i.e., KLKB1 expression, F12 expression, or KNG1 expression) in a cell. In other aspects, the present invention provides an iRNA of the invention and/or a composition comprising an iRNA of the invention for use in reducing and/or inhibiting contact activation pathway gene expression (i.e., KLKB1 expression, F12 expression, or KNG1 expression) in a cell. In yet other aspects, use of an iRNA of the invention and/or a composition comprising an iRNA of the invention for the manufacture of a medicament for reducing and/or inhibiting contact activation pathway gene expression (i.e., KLKB1 expression, F12 expression, or KNG1 expression) in a cell are provided. In still other aspects, the the present invention provides an iRNA of the invention and/or a composition comprising an iRNA of the invention for use in reducing and/or inhibiting contact activation pathway protein production (i.e., KLKB1 protein production, F12 protein production, or KNG1 protein production) in a cell. In yet other aspects, use of an iRNA of the invention and/or a composition comprising an iRNA of the invention for the manufacture of a medicament for reducing and/or inhibiting contact activation pathway protein production (i.e., KLKB1 protein production, F12 protein production, or KNG1 protein production) in a cell are provided. The methods and uses include contacting the cell with an iRNA, e.g., a dsRNA, of the invention and maintaining the cell for a time sufficient to obtain degradation of the mRNA transcript of the contact activation pathway gene, thereby inhibiting expression of the contact activation pathway gene or inhibiting contact activation pathway protein production in the cell.

Reduction in gene expression can be assessed by any methods known in the art. For example, a reduction in the expression of KLKB1 may be determined by determining the mRNA expression level of KLKB1 using methods routine to one of ordinary skill in the art, e.g., Northern blotting, qRT-PCR, by determining the protein level of KLKB1 using methods routine to one of ordinary skill in the art, such as Western blotting, immunological techniques, flow cytometry methods, ELISA, and/or by determining a biological activity of KLKB1.

In the methods and uses of the invention the cell may be contacted in vitro or in vivo, i.e., the cell may be within a subject.

A cell suitable for treatment using the methods of the invention may be any cell that expresses a contact activation pathway gene, e.g., a cell from a subject having hereditary angioedema (HAE) or a cell comprising an expression vector comprising a contact activation pathway gene or portion of a contact activation pathway gene. A cell suitable for use in the methods and uses of the invention may be a mammalian cell, e.g., a primate cell (such as a human cell or a non-human primate cell, e.g., a monkey cell or a chimpanzee cell), a non-primate cell (such as a cow cell, a pig cell, a camel cell, a llama cell, a horse cell, a goat cell, a rabbit cell, a sheep cell, a hamster, a guinea pig cell, a cat cell, a dog cell, a rat cell, a mouse cell, a lion cell, a tiger cell, a bear cell, or a buffalo cell), a bird cell (e.g., a duck cell or a goose cell), or a whale cell. In one embodiment, the cell is a human cell.

Contact activation pathway gene expression may be inhibited in the cell by at least about 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100%.

Contact activation pathway protein production may be inhibited in the cell by at least about 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100%.

The in vivo methods and uses of the invention may include administering to a subject a composition containing an iRNA, where the iRNA includes a nucleotide sequence that is complementary to at least a part of an RNA transcript of the contact activation pathway gene of the mammal to be treated. When the organism to be treated is a human, the composition can be administered by any means known in the art including, but not limited to subcutaneous, intravenous, oral, intraperitoneal, or parenteral routes, including intracranial (e.g., intraventricular, intraparenchymal and intrathecal), intramuscular, transdermal, airway (aerosol), nasal, rectal, and topical (including buccal and sublingual) administration. In certain embodiments, the compositions are administered by subcutaneous or intravenous infusion or injection. In one embodiment, the compositions are administered by subcutaneous injection.

In some embodiments, the administration is via a depot injection. A depot injection may release the iRNA in a consistent way over a prolonged time period. Thus, a depot injection may reduce the frequency of dosing needed to obtain a desired effect, e.g., a desired inhibition of KLKB1, or a therapeutic or prophylactic effect. A depot injection may also provide more consistent serum concentrations. Depot injections may include subcutaneous injections or intramuscular injections. In preferred embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intravenous, subcutaneous, arterial, or epidural infusions. In preferred embodiments, the infusion pump is a subcutaneous infusion pump. In other embodiments, the pump is a surgically implanted pump that delivers the iRNA to the subject.

The mode of administration may be chosen based upon whether local or systemic treatment is desired and based upon the area to be treated. The route and site of administration may be chosen to enhance targeting.

In one aspect, the present invention also provides methods for inhibiting the expression of an KLKB1 gene in a mammal, e.g., a human. The present invention also provides a composition comprising an iRNA, e.g., a dsRNA, that targets an KLKB1 gene in a cell of a mammal for use in inhibiting expression of the KLKB1 gene in the mammal. In another aspect, the present invention provides use of an iRNA, e.g., a dsRNA, that targets an KLKB1 gene in a cell of a mammal in the manufacture of a medicament for inhibiting expression of the KLKB1 gene in the mammal.

The methods and uses include administering to the mammal, e.g., a human, a composition comprising an iRNA, e.g., a dsRNA, that targets an KLKB1 gene in a cell of the mammal and maintaining the mammal for a time sufficient to obtain degradation of the mRNA transcript of the KLKB1 gene, thereby inhibiting expression of the KLKB1 gene in the mammal.

In another aspect, the present invention also provides methods for inhibiting the expression of an F12 gene in a mammal, e.g., a human. The present invention also provides a composition comprising an iRNA, e.g., a dsRNA, that targets an F12 gene in a cell of a mammal for use in inhibiting expression of the F12 gene in the mammal. In another aspect, the present invention provides use of an iRNA, e.g., a dsRNA, that targets an F12 gene in a cell of a mammal in the manufacture of a medicament for inhibiting expression of the F12 gene in the mammal.

The methods and uses include administering to the mammal, e.g., a human, a composition comprising an iRNA, e.g., a dsRNA, that targets an F12 gene in a cell of the mammal and maintaining the mammal for a time sufficient to obtain degradation of the mRNA transcript of the F12 gene, thereby inhibiting expression of the F12 gene in the mammal.

In yet another aspect, the present invention also provides methods for inhibiting the expression of an KNG1 gene in a mammal, e.g., a human. The present invention also provides a composition comprising an iRNA, e.g., a dsRNA, that targets an KNG1 gene in a cell of a mammal for use in inhibiting expression of the KNG1 gene in the mammal. In another aspect, the present invention provides use of an iRNA, e.g., a dsRNA, that targets an KNG1 gene in a cell of a mammal in the manufacture of a medicament for inhibiting expression of the KNG1 gene in the mammal.

The methods and uses include administering to the mammal, e.g., a human, a composition comprising an iRNA, e.g., a dsRNA, that targets an KNG1 gene in a cell of the mammal and maintaining the mammal for a time sufficient to obtain degradation of the mRNA transcript of the KNG1 gene, thereby inhibiting expression of the KNG1 gene in the mammal.

Reduction in gene expression can be assessed in peripheral blood sample of the iRNA-administered subject by any methods known it the art, e.g. qRT-PCR, described herein. Reduction in protein production can be assessed by any methods known it the art and by methods, e.g., ELISA or Western blotting, described herein. In one embodiment, a tissue sample serves as the tissue material for monitoring the reduction in contact activation pathway gene and/or protein expression. In another embodiment, a blood sample serves as the tissue material for monitoring the reduction in contact activation pathway gene and/or protein expression.

In one embodiment, verification of RISC medicated cleavage of target in vivo following administration of iRNA agent is done by performing 5'-RACE or modifications of the protocol as known in the art (Lasham A et al., (2010) *Nucleic Acid Res.,* 38 (3) p-e19) (Zimmermann et al. (2006) *Nature* 441: 111-4).

This invention is further illustrated by the following examples which should not be construed as limiting. The entire contents of all references, patents and published patent applications cited throughout this application, as well as the Figures and the Sequence Listing, are hereby incorporated herein by reference.

EXAMPLES

Example 1. KLKB1 iRNA Synthesis

Source of Reagents

Where the source of a reagent is not specifically given herein, such reagent can be obtained from any supplier of reagents for molecular biology at a quality/purity standard for application in molecular biology.

Transcripts siRNA Design

A set of siRNAs targeting human KLKB1, "kallikrein B, plasma (Fletcher factor) 1" (REFSeq Accession No. NM_000892.3, GI:78191797, GeneID: 3818, SEQ ID NO:1 and SEQ ID NO.2) and KLKB1 orthologs from toxicology species (cynomolgus monkey: RefSeq Accession No. XM_005556482, GI:544436072; rhesus monkey: RefSeq JU329355, GI:380802470; mouse: RefSeq NM_008455, GI:236465804; rat: RefSeq NM_012725, GI:162138904) was designed using custom R and Python scripts. The human KLKB1 RefSeq mRNA has a length of 2252 bases. The rationale and method for the set of siRNA designs is as follows: the predicted efficacy for every potential 19mer siRNA from position 72 through position 2252 of human KLKB1 mRNA (containing the the coding region and 3' UTR) was determined using a linear model that predicted the direct measure of mRNA knockdown based on the data of more than 20,000 distinct siRNA designs targeting a large number of vertebrate genes. Subsets of the KLKB1 siRNAs were designed with perfect or near-perfect matches between human, cynomolgus monkey and rhesus monkey. A further subset was designed with perfect or near-perfect matches to mouse and rat KLKB1 orthologs. For each strand of the siRNA, a custom Python script was used in a brute force search to measure the number and positions of mismatches between the siRNA and all potential alignments in the target species transcriptome. Extra weight was given to mismatches in the seed region, defined here as positions 2-9 of the antisense oligonucleotide, as well the cleavage site of the siRNA, defined here as positions 10-11 of the antisense oligonucleotide. The relative weights for the mismatches were 2.8 for seed mismatches, 1.2 for cleavage site mismatches, and 1 mismatches in other positions up through antisense position 19. Mismatches in the first position were ignored. A specificity score was calculated for each strand by summing the value of each weighted mismatch. Preference was given to siRNAs whose antisense score in human and cynomolgus monkey was greater than or equal to 3.0 and predicted efficacy was greater than or equal to 70% knockdown of the KLKB1 transcript. One set of siRNAs containing structure-activity modifications, including various 2'-O-methyl and 2'-fluoro substitution patterns, were also designed, synthesized and screened.

A detailed list of the unmodified KLKB1 sense and antisense strand sequences is shown in Table 3. A detailed list of the modified KLKB1 sense and antisense strand sequences is shown in Table 4.

siRNA Synthesis

KLKB1 siRNA sequences were synthesized at 1 μmol scale on a Mermade 192 synthesizer (BioAutomation) using the solid support mediated phosphoramidite chemistry. The solid support was controlled pore glass (500 A) loaded with custom GalNAc ligand or universal solid support (AM biochemical). Ancillary synthesis reagents, 2'-F and 2'-O-Methyl RNA and deoxy phosphoramidites were obtained from Thermo-Fisher (Milwaukee, WI) and Hongene (China). 2'F 2'-O-Methyl, GNA (glycol nucleic acids), 5'phosphate and other modifications were introduced using the corresponding phosphoramidites. Synthesis of 3' GalNAc conjugated single strands was performed on a GalNAc modified CPG support. Custom CPG universal solid support was used for the synthesis of antisense single strands. Coupling time for all phosphoramidites (100 mM in acetonitrile) was 5 min employing 5-Ethylthio-1H-tetrazole (ETT) as activator (0.6 M in acetonitrile). Phosphorothioate linkages were generated using a 50 mM solution of 3-((Dimethylamino-methylidene) amino)-3H-1,2,4-dithiazole-3-thione (DDTT, obtained from Chemgenes (Wilmington, MA, USA)) in anhydrous acetonitrile/pyridine (1:1 v/v). Oxidation time was 3 minutes. All sequences were synthesized with final removal of the DMT group ("DMT off").

Upon completion of the solid phase synthesis, oligoribonucleotides were cleaved from the solid support and deprotected in sealed 96 deep well plates using 200 μL Aqueous Methylamine reagents at 60° C. for 20 minutes. For sequences containing 2' ribo residues (2'-OH) that are protected with a tert-butyl dimethyl silyl (TBDMS) group, a second step deprotection was performed using TEA·3HF (triethylamine trihydro fluoride) reagent. To the methylamine deprotection solution, 200 uL of dimethyl sulfoxide (DMSO) and 300 ul TEA·3HF reagent was added and the solution was incubated for additional 20 min at 60° C. At the end of cleavage and deprotection step, the synthesis plate was allowed to come to room temperature and was precipitated by addition of 1 mL of acetontile:ethanol mixture (9:1). The plates were cooled at −80 C for 2 hrs, superanatant decanted carefully with the aid of a multi channel pipette. The oligonucleotide pellet was re-suspended in 20 mM NaOAc buffer and were desalted using a 5 mL HiTrap size exclusion column (GE Healthcare) on an AKTA Purifier System equipped with an A905 autosampler and a Frac 950 fraction collector. Desalted samples were collected in 96-well plates. Samples from each sequence were analyzed by LC-MS to confirm the identity, UV (260 nm) for quantification and a selected set of samples by IEX chromatography to determine purity.

Annealing of KLKB1 single strands was performed on a Tecan liquid handling robot. Equimolar mixture of sense and antisense single strands were combined and annealed in 96 well plates. After combining the complementary single strands, the 96-well plate was sealed tightly and heated in an oven at 100° C. for 10 minutes and allowed to come slowly to room temperature over a period 2-3 hours. The concentration of each duplex was normalized to 10 μM in 1×PBS and then submitted for in vitro screening assays.

Example 2. In Vitro Screening of KLKB1 siRNA Duplexes

Cell Culture and Transfections

Cos 7 cells (ATCC, Manassas, VA) were grown to near confluence at 37° C. in an atmosphere of 5% CO2 in DMEM (ATCC) supplemented with 10% FBS, before being released from the plate by trypsinization. Dual-Glo® Luciferase constructs were generated in the psiCHECK2 plasmid containing either approximately 2.2 kb of human KLKB1 genomic sequence or 2.5 kb of orthologous mouse KLKB1 genomic sequence. Each dual-luciferase plasmid was co-transfected with siRNA into approximately 15×10$^4$ cells using Lipofectamine 2000 (Invitrogen, Carlsbad CA. cat #11668-019). For each well of a 96 well plate, 0.2 μl of Lipofectamine was added to 10 ng of plasmid vector and a single siRNA (Tables 3 and 4) in 14.8 μl of Opti-MEM and allowed to complex at room temperature for 15 minutes. The mixture was then added to the cells which were resuspended in 80 μl of fresh complete media. Cells were incubated for 24 hours before luciferase was measured.

Single dose experiments were performed at 10 nM and 0.01 nM final duplex concentration and dose response experiments were done over a range of doses from 10 nM to 36 fM final duplex concentration over 8, 6-fold dilutions.

Dual-Glo® Luciferase Assay

Forty-eight hours after the siRNAs were transfected, Firefly (transfection control) and Renilla (fused to KLKB1 target sequence) luciferase were measured. First, media was removed from cells. Then Firefly luciferase activity was measured by adding 75 μl of Dual-Glo® Luciferase Reagent equal to the culture medium volume to each well and mix. The mixture was incubated at room temperature for 30 minutes before lunimescense (500 nm) was measured on a Spectramax (Molecular Devices) to detect the Firefly luciferase signal. Renilla luciferase activity was measured by adding 75 μl of room temperature Dual-Glo® Stop & Glo® Reagent to each well and the plates were incubated for 10-15 minutes before luminescence was again measured to determine the Renilla luciferase signal. The Dual-Glo® Stop & Glo® Reagent, quenches the firefly luciferase signal and sustaines luminescence for the Renilla luciferase reaction. siRNA activity was determined by normalizing the Renilla (KLKB1) signal to the Firefly (control) signal within each well. The magnitude of siRNA activity was then assessed relative to cells that were transfected with the same vector but were not treated with siRNA or were treated with a non-targeting siRNA. All transfections were done in triplicate.

Table 5 shows the results of a single dose screen in Cos 7 cells transfected with the indicated human KLKB1 iRNAs. Table 6 shows the results of a single dose screen in Cos 7 cells transfected with the indicated mouse KLKB1 iRNAs. Data are expressed as percent of mRNA remaining relative to negative control.

TABLE 2

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
|---|---|
| A | Adenosine-3'-phosphate |
| Af | 2'-fluoroadenosine-3'-phosphate |

TABLE 2-continued

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
|---|---|
| Afs | 2'-fluoroadenosine-3'-phosphorothioate |
| As | adenosine-3'-phosphorothioate |
| C | cytidine-3'-phosphate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine -3'-phosphorothioate |
| Us | uridine-3'-phosphorothioate |
| N | any nucleotide (G, A, C, T or U) |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L96 | N-[tris(GalNAc-alkyl)-amidodecanoyl)]-4-hydroxyprolinol Hyp-(GalNAc-alkyl)3 |
| (dt) | deoxy-thymine |
| Y34 | 2-hydroxymethyl-tetrahydrofurane-4-methoxy-3-phosphate (abasic 2'-OMe furanose) |
| Y44 | 2-hydroxymethyl-tetrahydrofurane-5-phosphate |
| (Agn) | Adenosine-glycol nucleic acid (GNA) |
| (Tgn) | Thymidine-glycol nucleic acid (GNA) S-Isomer |
| (Cgn) | Cytidine-glycol nucleic acid (GNA) |
| P | Phosphate |
| VP | Vinyl-phosphate |

TABLE 3

Unmodified Sense and Antisense Strand Sequences of KLKB1 dsRNAs

| Duplex Name | Sense Oligo Name | Sense Sequence 5' to 3' | SEQ ID NO: | Antisense Oligo Name | Antisense Sequence 5' to 3' | SEQ ID NO: | Position in NM_000892.3 |
|---|---|---|---|---|---|---|---|
| AD-65077 | A-129940 | AAUCCAAAAUAUUCUACAAAA | 30 | A-129941 | UUUUGUAGAAUAUUUUGGAUUUC | 117 | 1661-1682 |
| AD-65170 | A-130248 | CUGGUCAUCAAAUAAGUGCUU | 31 | A-130249 | AAGCACUUAUUUGAUGACCAGAU | 118 | 382-403 |
| AD-65103 | A-130010 | GUGGUCAUCAAAUAAGUGCUU | 32 | A-130011 | AAGCACUUAUUUGAUGACCACAU | 119 | 382-403 |
| AD-65083 | A-129942 | CAUGGACUGGAUUUUAGAGAA | 33 | A-129943 | UUCUCUAAAAUCCAGUCCAUGUA | 120 | 1922-1943 |
| AD-65087 | A-130004 | ACCAAAGUCGCUGAGUACAUA | 34 | A-130005 | UAUGUACUCAGCGACUUUGGUGU | 121 | 1905-1926 |
| AD-65149 | A-130178 | GAUGGACUGGAUUUUAGAGAA | 35 | A-130179 | UUCUCUAAAAUCCAGUCCAUCUA | 122 | 1922-1943 |
| AD-64652 | A-129275 | UAUGAGAGGAGUCAAUUUUAA | 36 | A-129276 | UUAAAAUUGACUCCUCUCAUAUC | 123 | 431-452 |

TABLE 3-continued

Unmodified Sense and Antisense Strand Sequences of KLKB1 dsRNAs

| Duple Name | Sense Oligo Name | Sense Sequence 5' to 3' | SEQ ID NO: | Antisense Oligo Name | Antisense Sequence 5' to 3' | SEQ ID NO: | Position in NM_000892.3 |
|---|---|---|---|---|---|---|---|
| AD-65162 | A-130198 | AAUGAGAGGAGUCAAUUUUAA | 37 | A-130199 | UUAAAAUUGACUCCUCUCAUUUC | 124 | 431-452 |
| AD-65153 | A-130242 | UCCAAAGUCGCUGAGUACAUA | 38 | A-130243 | UAUGUACUCAGCGACUUUGGAGU | 125 | 1905-1926 |
| AD-65084 | A-129958 | AUUCUACAAAAGGUAAAUAUU | 39 | A-129959 | AAUAUUUACCUUUUGUAGAAUAU | 126 | 1671-1692 |
| AD-65099 | A-129948 | UUUCUCACAAAUAAAAGAGAU | 40 | A-129949 | AUCUCUUUUAUUUGUGAGAAAGG | 127 | 1457-1478 |
| AD-65100 | A-129962 | UAUCAAGAUUAUAAAAUAACA | 41 | A-129963 | UGUUAUUUUAUAAUCUUGAUAUC | 128 | 1725-1746 |
| AD-65090 | A-129960 | CUUCUUGAAAGAUAGUGUUAA | 42 | A-129961 | UUAACACUAUCUUUCAAGAAGCA | 129 | 302-323 |
| AD-65085 | A-129972 | GAAUGUUUGCCAAGAGACUUA | 43 | A-129973 | UAAGUCUCUUGGCAAACAUUCAC | 130 | 1016-1037 |
| AD-65062 | A-129980 | AUAUUCCUUUGGUAACAAAUA | 44 | A-129981 | UAUUUGUUACCAAAGGAAUAUUU | 131 | 1687-1708 |
| AD-65164 | A-130230 | CGUCAUCAAAUAAGUGCUUGA | 45 | A-130231 | UCAAGCACUUAUUUGAUGACGAC | 132 | 384-405 |
| AD-65139 | A-130206 | UCCUGCAAAAGAACUUUACCU | 46 | A-130207 | AGGUAAAGUUCUUUUGCAGGAUA | 133 | 918-939 |
| AD-65151 | A-130210 | CAAUGUUUGCCAAGAGACUUA | 47 | A-130211 | UAAGUCUCUUGGCAAACAUUGAC | 134 | 1016-1037 |
| AD-65158 | A-130228 | AGACACAAGCACAAUUUAUAA | 48 | A-130229 | UUAUAAAUUGUGCUUGUGUCUCC | 135 | 1595-1616 |
| AD-65078 | A-129956 | CGAGUCACAAAGAAAUGUUUA | 49 | A-129957 | UAAACAUUUCUUUGUGACUCGAU | 136 | 818-839 |
| AD-65161 | A-130182 | AUCUUGAAAGAUAGUGUUACA | 50 | A-130183 | UGUAACACUAUCUUUCAAGAUGC | 137 | 303-324 |
| AD-65076 | A-130016 | AAUGUGGUCAUCAAAUAAGUA | 51 | A-130017 | UACUUAUUUGAUGACCACAUUGC | 138 | 379-400 |
| AD-65093 | A-130006 | GUUACUCUUUGAGAUUGUGUA | 52 | A-130007 | UACACAAUCUCAAAGAGUAACCA | 139 | 1177-1198 |
| AD-65156 | A-130196 | GUUCUUGAAAGAUAGUGUUAA | 53 | A-130197 | UUAACACUAUCUUUCAAGAACCA | 140 | 302-323 |
| AD-65059 | A-129934 | GACUUUGGAGGAGAAGAAUUA | 54 | A-129935 | UAAUUCUUCUCCUCCAAAGUCAA | 141 | 972-993 |
| AD-65073 | A-129968 | ACCUGCAAAAGAACUUUACCU | 55 | A-129969 | AGGUAAAGUUCUUUUGCAGGUUA | 142 | 918-939 |
| AD-65074 | A-129984 | AUCGAGUCACAAAGAAAUGUU | 56 | A-129985 | AACAUUUCUUUGUGACUCGAUUU | 143 | 816-837 |
| AD-65092 | A-129990 | UGACACAAGCACAAUUUAUAA | 57 | A-129991 | UUAUAAAUUGUGCUUGUGUCACC | 144 | 1595-1616 |
| AD-65097 | A-129992 | GGUCAUCAAAUAAGUGCUUGA | 58 | A-129993 | UCAAGCACUUAUUUGAUGACCAC | 145 | 384-405 |
| AD-65101 | A-129978 | UGGUCAUCAAAUAAGUGCUUA | 59 | A-129979 | UAAGCACUUAUUUGAUGACCACA | 146 | 383-404 |
| AD-65131 | A-130172 | AGCCAGAAAAGAUAUCAAGAU | 60 | A-130173 | AUCUUGAUAUCUUUUCUGGCUUU | 147 | 1713-1734 |
| AD-65159 | A-130244 | CUUACUCUUUGAGAUUGUGUA | 61 | A-130245 | UACACAAUCUCAAAGAGUAAGCA | 148 | 1177-1198 |
| AD-65150 | A-130194 | UUUCUACAAAAGGUAAAUAUU | 62 | A-130195 | AAUAUUUACCUUUUGUAGAAAAU | 149 | 1671-1692 |
| AD-65060 | A-129950 | CACAAUGGAAUGUGGCGUUUA | 63 | A-129951 | UAAACGCCACAUUCCAUUGUGUU | 150 | 1827-1848 |
| AD-65098 | A-130008 | UUACUCUUUGAGAUUGUGUAA | 64 | A-130009 | UUACACAAUCUCAAAGAGUAACC | 151 | 1178-1199 |
| AD-65067 | A-129966 | UACUCUUUGAGAUUGUGUAAA | 65 | A-129967 | UUUACACAAUCUCAAAGAGUAAC | 152 | 1179-1200 |
| AD-65065 | A-129936 | UGCCAGAAAAGAUAUCAAGAU | 66 | A-129937 | AUCUUGAUAUCUUUUCUGGCAUU | 153 | 1713-1734 |
| AD-65095 | A-129946 | UUCUUGAAAGAUAGUGUUACA | 67 | A-129947 | UGUAACACUAUCUUUCAAGAAGC | 154 | 303-324 |
| AD-65126 | A-130186 | GACAAUGGAAUGUGGCGUUUA | 68 | A-130187 | UAAACGCCACAUUCCAUUGUCUU | 155 | 1827-1848 |
| AD-65157 | A-130212 | AAUAAAAUAACCCAACGGAUA | 69 | A-130213 | UAUCCGUUGGGUUAUUUUAUUAU | 156 | 1734-1755 |
| AD-65086 | A-129988 | CUUAAAACAUCUGAAAGUGGA | 70 | A-129989 | UCCACUUUCAGAUGUUUUAAGAA | 157 | 843-864 |
| AD-65167 | A-130200 | AAUCAAGAUUAUAAAAUAACA | 71 | A-130201 | UGUUAUUUUAUAAUCUUGAUUUC | 158 | 1725-1746 |
| AD-65071 | A-129938 | AGUAACGUGGAAUCUGGAUUA | 72 | A-129939 | UAAUCCAGAUUCCACGUUACUCA | 159 | 618-639 |
| AD-65066 | A-129952 | UAUAAAGGAGUUGAUAUGAGA | 73 | A-129953 | UCUCAUAUCAACUCCUUUAUAAA | 160 | 417-438 |

TABLE 3-continued

Unmodified Sense and Antisense Strand Sequences of KLKB1 dsRNAs

| Duple Name | Sense Oligo Name | Sense Sequence 5' to 3' | SEQ ID NO: | Antisense Oligo Name | Antisense Sequence 5' to 3' | SEQ ID NO: | Position in NM_000892.3 |
|---|---|---|---|---|---|---|---|
| AD-65165 | A-130246 | AUACUCUUUGAGAUUGUGUAA | 74 | A-130247 | UUACACAAUCUCAAAGAGUAUCC | 161 | 1178-1199 |
| AD-65132 | A-130188 | AAUAAAGGAGUUGAUAUGAGA | 75 | A-130189 | UCUCAUAUCAACUCCUUUAUUAA | 162 | 417-438 |
| AD-65125 | A-130170 | CACUUUGGAGGAGAAGAAUUA | 76 | A-130171 | UAAUUCUUCUCCUCCAAAGUGAA | 163 | 972-993 |
| AD-65091 | A-129974 | UAUAAAAUAACCCAACGGAUA | 77 | A-129975 | UAUCCGUUGGGUUAUUUUAUAAU | 164 | 1734-1755 |
| AD-65136 | A-130252 | GAAUGUGGUCAUCAAAUAAGU | 78 | A-130253 | ACUUAUUUGAUGACCACAUUCCU | 165 | 378-399 |
| AD-65137 | A-130174 | UGUAACGUGGAAUCUGGAUUA | 79 | A-130175 | UAAUCCAGAUUCCACGUUACACA | 166 | 618-639 |
| AD-65140 | A-130222 | UUCGAGUCACAAAGAAAUGUU | 80 | A-130223 | AACAUUUCUUUGUGACUCGAAUU | 167 | 816-837 |
| AD-65128 | A-130218 | UUAUUCCUUUGGUAACAAAUA | 81 | A-130219 | UAUUUGUUACCAAAGGAAUAAUU | 168 | 1687-1708 |
| AD-65088 | A-130020 | ACACAAGCACAAUUUAUACCA | 82 | A-130021 | UGGUAUAAAUUGUGCUUGUGUCA | 169 | 1597-1618 |
| AD-65160 | A-130260 | CUGGAAUCUGGAUUCUCACUA | 83 | A-130261 | UAGUGAGAAUCCAGAUUCCAGGU | 170 | 624-645 |
| AD-65152 | A-130226 | GUUAAAACAUCUGAAAGUGGA | 84 | A-130227 | UCCACUUUCAGAUGUUUUAACAA | 171 | 843-864 |
| AD-65133 | A-130204 | AACUCUUUGAGAUUGUGUAAA | 85 | A-130205 | UUUACACAAUCUCAAAGAGUUAC | 172 | 1179-1200 |
| AD-65082 | A-130018 | GCAAUGUGGUCAUCAAAUAAA | 86 | A-130019 | UUUAUUUGAUGACCACAUUGCUU | 173 | 377-398 |
| AD-65094 | A-130022 | GUGGAAUCUGGAUUCUCACUA | 87 | A-130023 | UAGUGAGAAUCCAGAUUCCACGU | 174 | 624-645 |
| AD-65155 | A-130180 | GGCAUUGUUGGAGGAACAAAA | 88 | A-130181 | UUUUGUUCCUCCAACAAUGCCUG | 175 | 1239-1260 |
| AD-65163 | A-130214 | UUUGUUGGAGGAACAAACUCU | 89 | A-130215 | AGAGUUUGUUCCUCCAACAAAGC | 176 | 1242-1263 |
| AD-65144 | A-130192 | GGAGUCACAAAGAAAUGUUUA | 90 | A-130193 | UAAACAUUUCUUUGUGACUCCAU | 177 | 818-839 |
| AD-65096 | A-129976 | AUUGUUGGAGGAACAAACUCU | 91 | A-129977 | AGAGUUUGUUCCUCCAACAAUGC | 178 | 1242-1263 |
| AD-65142 | A-130254 | UAUGUGGUCAUCAAAUAAGUA | 92 | A-130255 | UACUUAUUUGAUGACCACAUAGC | 179 | 379-400 |
| AD-65141 | A-130238 | CAAAAGAUGCUUGUAAGGGAA | 93 | A-130239 | UUCCCUUACAAGCAUCUUUUGCC | 180 | 1780-1801 |
| AD-65079 | A-129970 | GUCUGUGCUGGCUAUAAAGAA | 94 | A-129971 | UUCUUUAUAGCCAGCACAGACCA | 181 | 1755-1776 |
| AD-65102 | A-129994 | AGCAGUGUUGAAGAAUGCCAA | 95 | A-129995 | UUGGCAUUCUUCAACACUGCUAA | 182 | 465-486 |
| AD-65138 | A-130190 | GUGUGUGGAGGGUCACUCAUA | 96 | A-130191 | UAUGAGUGACCCUCCACACACGU | 183 | 1323-1344 |
| AD-65075 | A-130000 | GAAAAGAUGCUUGUAAGGGAA | 97 | A-130001 | UUCCCUUACAAGCAUCUUUUCCC | 184 | 1780-1801 |
| AD-65080 | A-129986 | ACAUCGAAAGUGGCACACCA | 98 | A-129987 | UGGUGUGCCACUUUCAGAUGUUU | 185 | 849-870 |
| AD-65145 | A-130208 | CUCUGUGCUGGCUAUAAAGAA | 99 | A-130209 | UUCUUUAUAGCCAGCACAGAGCA | 186 | 1755-1776 |
| AD-65169 | A-130232 | UGCAGUGUUGAAGAAUGCCAA | 100 | A-130233 | UUGGCAUUCUUCAACACUGCAAA | 187 | 465-486 |
| AD-65061 | A-129964 | UUCUUAAAACAUCUGAAAGUA | 101 | A-129965 | UACUUUCAGAUGUUUUAAGAAGA | 188 | 841-862 |
| AD-65135 | A-130236 | UAGCACAAUUUAUACCAACUA | 102 | A-130237 | UAGUUGGUAUAAAUUGUGCUAGU | 189 | 1601-1622 |
| AD-65068 | A-129982 | UGGAAUGUGGCGUUUGGUGGA | 103 | A-129983 | UCCACCAAACGCCACAUUCCAUU | 190 | 1832-1853 |
| AD-65148 | A-130256 | CCAAUGUGGUCAUCAAAUAAA | 104 | A-130257 | UUUAUUUGAUGACCACAUUGGUU | 191 | 377-398 |
| AD-65072 | A-129954 | CUGUGUGGAGGGUCACUCAUA | 105 | A-129955 | UAUGAGUGACCCUCCACACAGGU | 192 | 1323-1344 |
| AD-65146 | A-130224 | UCAUCGAAAGUGGCACACCA | 106 | A-130225 | UGGUGUGCCACUUUCAGAUGAUU | 193 | 849-870 |
| AD-65129 | A-130234 | CCACAAUUUAUACCAACUGUU | 107 | A-130235 | AACAGUUGGUAUAAAUUGUGGUU | 194 | 1603-1624 |
| AD-65064 | A-130012 | CACAAGCACAAUUUAUACCAA | 108 | A-130013 | UUGGUAUAAAUUGUGCUUGUGUC | 195 | 1598-1619 |
| AD-65134 | A-130220 | AGGAAUGUGGCGUUUGGUGGA | 109 | A-130221 | UCCACCAAACGCCACAUUCCUUU | 196 | 1832-1853 |

TABLE 3-continued

Unmodified Sense and Antisense Strand Sequences of KLKB1 dsRNAs

| Duple Name | Sense Oligo Name | Sense Sequence 5' to 3' | SEQ ID NO: | Antisense Oligo Name | Antisense Sequence 5' to 3' | SEQ ID NO: | Position in NM_000892.3 |
|---|---|---|---|---|---|---|---|
| AD-65063 | A-129996 | GCACAAUUUAUACCAACUGUU | 110 | A-129997 | AACAGUUGGUAUAAAUUGUGCUU | 197 | 1603-1624 |
| AD-65089 | A-129944 | CGCAUUGUUGGAGGAACAAAA | 111 | A-129945 | UUUUGUUCCUCCAACAAUGCGUG | 198 | 1239-1260 |
| AD-65069 | A-129998 | AAGCACAAUUUAUACCAACUA | 112 | A-129999 | UAGUUGGUAUAAAUUGUGCUUGU | 199 | 1601-1622 |
| AD-65130 | A-130250 | GACAAGCACAAUUUAUACCAA | 113 | A-130251 | UUGGUAUAAAUUGUGCUUGUCUC | 200 | 1598-1619 |
| AD-65147 | A-130240 | UUUUACCCGGGAGUUGACUUU | 114 | A-130241 | AAAGUCAACUCCCGGGUAAAAUU | 201 | 957-978 |
| AD-65081 | A-130002 | AUUUACCCGGGAGUUGACUUU | 115 | A-130003 | AAAGUCAACUCCCGGGUAAAUUU | 202 | 957-978 |
| AD-65154 | A-130258 | UCACAAGCACAAUUUAUACCA | 116 | A-130259 | UGGUAUAAAUUGUGCUUGUGACA | 203 | 1597-1618 |

TABLE 4

Modified Sense and Antisense Strand Sequences of KLKB1 dsRNAs

| Duplex Name | Sense Oligo Name | Sense Sequence 5' to 3' | SEQ ID NO: | Antisense Oligo Nmae | Antisense Sequence 5' to 3' | SEQ ID NO: |
|---|---|---|---|---|---|---|
| AD-65077 | A-129940 | AfsasUfcCfaAfaAfUfAfuUfcUfaCfaAfaAfL96 | 204 | A-129941 | usUfsuUfgUfaGfaAfuauUfuUfgGfaUfususc | 291 |
| AD-65170 | A-130248 | CfsusGfgUfcAfuCfAfaAfUfaAfgUfgCfuUfL96 | 205 | A-130249 | asAfsgCfaCfuUfaUfuugAfuUfgfaCfcAfgsasu | 292 |
| AD-65103 | A-130010 | GfsusGfgUfcAfuCfAfaAfUfaAfgUfgCfuUfL96 | 206 | A-130011 | asAfsgCfaCfuUfaUfuugAfuUfgfaCfcAfcsasu | 293 |
| AD-65083 | A-129942 | CfsasUfgGfaCfuGfGfAfuUfuUfaGfaGfaAfL96 | 207 | A-129943 | usUfscUfcUfaAfaAfuccAfgUfcCfaUfgsusa | 294 |
| AD-65087 | A-130004 | AfscsCfaAfaAfuGfuCfGfCfuGfaGfuAfcAfuAfL96 | 208 | A-130005 | usAfsuGfuAfcUfcAfgcgAfcAfuUfuUfgGfusgsu | 295 |
| AD-65149 | A-130178 | GfsasUfgGfaCfuGfGfAfuUfuUfaGfaGfaAfL96 | 209 | A-130179 | usUfscUfcUfaAfaAfuccAfgUfcCfaUfcsusa | 296 |
| AD-64652 | A-129275 | UfsasUfgAfgAfgGfAfGfuCfaAfuUfuUfaAfL96 | 210 | A-129276 | usUfsaAfaAfuUfgAfcucCfuCfuCfaUfasusc | 297 |
| AD-65162 | A-130198 | AfsasUfgAfgAfgGfAfGfuCfaAfuUfuUfaAfL96 | 211 | A-130199 | usUfsaAfaAfuUfgAfcucCfuCfuCfaUfususc | 298 |
| AD-65153 | A-130242 | UfscsCfaAfaAfuGfuCfGfCfuGfaGfuAfcAfuAfL96 | 212 | A-130243 | usAfsuGfuAfcUfcAfgcgAfcAfuUfuUfgGfasgsu | 299 |
| AD-65084 | A-129958 | AfsusUfcUfaCfaAfAfAfgGfuAfaAfuAfuUfL96 | 213 | A-129959 | asAfsuAfuUfuAfcCfuuuUfgUfaGfaAfusasu | 300 |
| AD-65099 | A-129948 | UfsusUfcUfcAfcAfAfAfuAfaAfaGfaGfaUfL96 | 214 | A-129949 | asUfscUfcUfuUfuAfuuuGfuGfaGfaAfasgsg | 301 |
| AD-65100 | A-129962 | UfsasUfcAfaGfaUfUfAfuAfaAfaUfaAfcAfL96 | 215 | A-129963 | usGfsuUfaUfuUfuAfuaaUfcUfuGfaUfasusc | 302 |
| AD-65090 | A-129960 | CfsusUfcUfuGfaAfAfGfaUfaGfuGfuUfaAfL96 | 216 | A-129961 | usUfsaAfcAfcUfaUfcuuUfcAfaGfaAfgscsa | 303 |
| AD-65085 | A-129972 | GfsasAfuGfuUfuGfCfCfaAfgAfgAfcUfuAfL96 | 217 | A-129973 | usAfsaGfuCfuCfuUfggcAfaAfcAfuUfcsasc | 304 |
| AD-65062 | A-129980 | AfsusAfuUfcCfuUfUfGfgUfaAfcAfuAfuAfL96 | 218 | A-129981 | usAfsuUfgUfuAfCfcaaAfgGfaAfuAfusususu | 305 |
| AD-65164 | A-130230 | CfsgsUfcAfuCfaAfAfUfaAfgUfgCfuUfgAfL96 | 219 | A-130231 | usCfsaAfgCfaCfuUfauuUfgAfuGfaCfgsasc | 306 |

TABLE 4-continued

Modified Sense and Antisense Strand Sequences of KLKB1 dsRNAs

| Duplex Name | Sense Oligo Name | Sense Sequence 5' to 3' | SEQ ID NO: | Antisense Oligo Nmae | Antisense Sequence 5' to 3' | SEQ ID NO: |
|---|---|---|---|---|---|---|
| AD-65139 | A-130206 | UfscsCfuGfcAfaAfAfGfaAfcUfuUfaCfcUfL96 | 220 | A-130207 | asGfsgUfaAfaGfuUfcuuUfuGfcAfgGfasusa | 307 |
| AD-65151 | A-130210 | CfsasAfuGfuUfuGfCfCfaAfgAfgAfcUfuAfL96 | 221 | A-130211 | usAfsaGfuCfuCfuUfggcAfaAfcAfuUfgsasc | 308 |
| AD-65158 | A-130228 | AfsgsAfcAfcAfaGfCfAfcAfaUfuUfaUfaAfL96 | 222 | A-130229 | usUfsaUfaAfaUfuGfugcUfuGfuGfuCfuscsc | 309 |
| AD-65078 | A-129956 | CfsgsAfgUfcAfcAfaAfgAfaAfuGfuUfaAfL96 | 223 | A-129957 | usAfsaAfcAfuUfuCfuuuGfuGfaCfuCgfsasu | 310 |
| AD-65161 | A-130182 | AfsusCfuUfgAfaAfGfAfuAfgUfgUfuAfcAfL96 | 224 | A-130183 | usGfsuAfaCfaCfuAfucuUfuCfaAfgAfusgsc | 311 |
| AD-65076 | A-130016 | AfsasUfgUfgGfuCfAfUfcAfaAfuAfaGfuAfL96 | 225 | A-130017 | usAfscUfaAfuUfuGfaugAfcCfaCfaUfusgsc | 312 |
| AD-65093 | A-130006 | GfsusUfaCfuCfuUfUfGfaGfaUfuGfuGfaAfL96 | 226 | A-130007 | usAfscAfcAfaUfcUfcaaAfgAfgUfaAfcscsa | 313 |
| AD-65156 | A-130196 | GfsusUfcUfuGfaAfAfGfaUfaGfuGfuUfaAfL96 | 227 | A-130197 | usUfsaAfcAfcUfaUfcuuUfcAfaGfaAfcscsa | 314 |
| AD-65059 | A-129934 | GfsasCfuUfuGfgAfGfGfaGfaAfgAfaUfuAfL96 | 228 | A-129935 | usAfsaUfCfuUfcUfccuCfcAfaAfgUfcsasa | 315 |
| AD-65073 | A-129968 | AfscsCfuGfcAfaAfAfGfaAfcUfuUfaCfcUfL96 | 229 | A-129969 | asGfsgUfaAfaGfuUfcuuUfuGfcAfgGfususa | 316 |
| AD-65074 | A-129984 | AfsusCfgAfgUfcAfCfCfAfaAfgAfaAfuGfuUfL96 | 230 | A-129985 | asAfscAfuUfuCfuUfuguGfaCfuCfgAfususu | 317 |
| AD-65092 | A-129990 | UfsgsAfcAfcAfaGfCfCfaAfcAfuUfaUfaAfL96 | 231 | A-129991 | usUfsaUfaAfaUfuGfugcUfuGfuGfuCfascsc | 318 |
| AD-65097 | A-129992 | GfsgsUfcAfuCfaAfAffUfaAfgUfgCfuUfgAfL96 | 232 | A-129993 | usCfsaAfgCfaCfuUfauuUfgAfuGfaCfcsasc | 319 |
| AD-65101 | A-129978 | UfsgsGfuCfaUfcAfAfAfuAfaGfuGfcUfuAfL96 | 233 | A-129979 | usAfsaGfcAfcUfuAfuuuGfaUfgAfcCfascsa | 320 |
| AD-65131 | A-130172 | AfsgsCfcAfgAfaAfAfGfaUfaUfcAfaGfaUfL96 | 234 | A-130173 | asUfscUfuGfaUfaUfcuuUfuCfuGfgCfususu | 321 |
| AD-65159 | A-130244 | CfsusUfaCfuCfuUtUfGfaGfaUfuGfuGfaAfL96 | 235 | A-130245 | usAfscAfcAfaUfcUfcaaAfgAfgUfaAfgscsa | 322 |
| AD-65150 | A-130194 | UfsusUfcUfaCfaAfAfAfgGfuAfaAfuAfuUfL96 | 236 | A-130195 | asAfsuAfuUfuAfcCfuuuUfgUfaGfaAfasasu | 323 |
| AD-65060 | A-129950 | CfsasCfaAfuGfAfAfUfgUfgGfcGfuUfuAfL96 | 237 | A-129951 | usAfsaAfcGfcCfaCfauuCfcAfuUfgUfgsusu | 324 |
| AD-65098 | A-130008 | UfsusAfcUfcUfuUfGfAfgAfuUfgUfgUfaAfL96 | 238 | A-130009 | usUfsaCfaCfaAfuCfucaAfaGfaGfuAfascsc | 325 |
| AD-65067 | A-129966 | UfsasCfuCfuUfuGfAfGfaUfuGfuGfuAfaAfL96 | 239 | A-129967 | usUfsuAfcAfcAfaUfcucAfaAfgAfgUfasasc | 326 |
| AD-65065 | A-129936 | UfsgsCfcAfgAfaAfAfGfaUfaUfcAfaGfaUfL96 | 240 | A-129937 | asUfscUfuGfaUfaUfcuuUfuCfuGfgCfasusu | 327 |
| AD-65095 | A-129946 | UfsusCfuUfgAfaAfGfAfuAfgUfgUfuAfcAfL96 | 241 | A-129947 | usGfsuAfaCfaCfuAfucuUfuCfaAfgAfasgsc | 328 |
| AD-65126 | A-130186 | GfsasCfaAfuGfAfAfUfgUfgGfcGfuUfuAfL96 | 242 | A-130187 | usAfsaAfcGfcCfaCfauuCfcAfuUfgUfcsusu | 329 |
| AD-65157 | A-130212 | AfsasUfaAfaAfuAfAfCfcAfaCfGfAfuAfL96 | 243 | A-130213 | usAfsuCfcGfuUfgGfguuAfuUfuU faUfusasu | 330 |
| AD-65086 | A-129988 | CfsusUfaAfaAfcAfUfCfuGfaAfaGfuGfAfL96 | 244 | A-129989 | usCfscAfcUfuUfcAfgauGfuUfuU faAfgsasa | 331 |

TABLE 4-continued

Modified Sense and Antisense Strand Sequences of KLKB1 dsRNAs

| Duplex Name | Sense Oligo Name | Sense Sequence 5' to 3' | SEQ ID NO: | Antisense Oligo Nmae | Antisense Sequence 5' to 3' | SEQ ID NO: |
|---|---|---|---|---|---|---|
| AD-65167 | A-130200 | AfsasUfcAfaGfaUfUfAfuAf aAfaUfaAfcAfL96 | 245 | A-130201 | usGfsuUfaUfuUfuAfuaaUfcUfuG faUfususc | 332 |
| AD-65071 | A-129938 | AfsgsUfaAfcGfuGfGfAfaUf cUfgGfaUfuAfuAfL96 | 246 | A-129939 | usAfsaUfcCfaGfaUfuccAfcGfuU faCfuscsa | 333 |
| AD-65066 | A-129952 | UfsasUfaAfaGfgAfGfUfuGf aUfaUfgAfgAfgAfL96 | 247 | A-129953 | usCfsuCfaUfaUfcAfacuCfcUfuU faUfasasa | 334 |
| AD-65165 | A-130246 | AfsusAfcUfcUfuUfGfAfgAf uUfgUfgUfaAfL96 | 248 | A-130247 | usUfsaCfaCfaAfuCfucaAfaGfaG fuAfuscsc | 335 |
| AD-65132 | A-130188 | AfsasUfaAfaGfgAfGfUfuGf aUfaUfgAfgAfgAfL96 | 249 | A-130189 | usCfsuCfaUfaUfcAfacuCfcUfuU faUfusasa | 336 |
| AD-65125 | A-130170 | CfsasCfuUfuGfgAfGfGfaGf aAfgAfaUfuAfL96 | 250 | A-130171 | usAfsaUfuCfuUfufcUfccuCfcAfaA fgUfgsasa | 337 |
| AD-65091 | A-129974 | UfsasUfaAfaAfuAfAfCfcCf aAfcGfgAfuAfL96 | 251 | A-129975 | usAfsuCfcGfuUfgGfguuAfuUfuU faUfasasu | 338 |
| AD-65136 | A-130252 | GfsasAfuGfuGfgUfCfAfuCf aAfaUfaAfgUfL96 | 252 | A-130253 | asCfsuUfaUfuUfgAfugaCfcAfcA fuUfcscsu | 339 |
| AD-65137 | A-130174 | UfsgsUfaAfcGfuGfGfAfaUf cUfgGfaUfuAfL96 | 253 | A-130175 | usAfsaUfcCfaGfaUfuccAfcGfuU faCfascsa | 340 |
| AD-65140 | A-130222 | UfsusCfgAfgUfcAfCfAfaAf gAfaAfuGfuUfL96 | 254 | A-130223 | asCfscAfuUfuCfuUfuguGfaCfuC fgAfasusu | 341 |
| AD-65128 | A-130218 | UfsusAfuUfcCfuUfUfGfgUf aAfcAfaAfuAfL96 | 255 | A-130219 | usAfsuUfuGfuUfaCfcaaAfgGfaA fuAfasusu | 342 |
| AD-65088 | A-130020 | AfscsAfcAfaGfcAfCfAfaUf uUfaUfaCfcAfL96 | 256 | A-130021 | usGfsgUfaUfaAfaUfuguGfcUfuG fuGfuscsa | 343 |
| AD-65160 | A-130260 | CfsusGfgAfaUfcUfGfGfaUf uCfuCfaCfuAfL96 | 257 | A-130261 | usAfsgUfgAfgAfaUfccaGfaUfuC fcAfgsgsu | 344 |
| AD-65152 | A-130226 | GfsusUfaAfaAfcAfUfCfuGf aAfaGfuGfgAfL96 | 258 | A-130227 | usCfscAfcUfuUfcAfgauGfuUfuU faAfcsasa | 345 |
| AD-65133 | A-130204 | AfsasCfuCfuUfuGfAfGfaUf uGfuGfuAfaAfL96 | 259 | A-130205 | usUfsuAfcAfcAfaUfcucAfaAfgA fgUfusasc | 346 |
| AD-65082 | A-130018 | GfscsAfaUfgUfgGfUfCfaUf cAfaAfuAfaAfL96 | 260 | A-130019 | usUfsuAfuUfuGfaUfgacCfaCfaU fuGfcsusu | 347 |
| AD-65094 | A-130022 | GfsusGfgAfaUfcUfGfGfaUf uCfuCfaCfuAfL96 | 261 | A-130023 | usAfsgUfgAfgAfaUfccaGfaUfuC fcAfcsgsu | 348 |
| AD-65155 | A-130180 | GfsgsCfaUfuGfuUfGfGfaGf gAfaCfaAfaAfL96 | 262 | A-130181 | usUfsuUfgUfuCfcUfccaAfcAfaU fgCfcsusg | 349 |
| AD-65163 | A-130214 | UfsusUfgUfuGfaGfGfGfaAf cAfaAfcUfcUfL96 | 263 | A-130215 | asGfsaGfuUfuGfuUfccuCfcAfaC faAfasgsc | 350 |
| AD-65144 | A-130192 | GfsgsAfgUfcAfcAfAffAfgAf aAfuGfuUfuAfL96 | 264 | A-130193 | usAfsaAfcAfuUfuCfuuuGfuGfaC fuCfcsasu | 351 |
| AD-65096 | A-129976 | AfsusUfgUfuGfaGfGfGfaAf cAfaAfcUfcUfL96 | 265 | A-129977 | asGfsaGfuUfuGfuUfccuCfcAfaC faAfusgsc | 352 |
| AD-65142 | A-130254 | UfsasUfgUfgGfuCfAfUfcAf aAfuAfaGfuAfL96 | 266 | A-130255 | usAfscUfuAfuUfuGfaugAfcCfaC faUfasgsc | 353 |
| AD-65141 | A-130238 | CfsasAfaAfgAfuGfCfUfuGf uAfaGfgAfaAfL96 | 267 | A-130239 | usUfscCfcUfuAfcAfagcAfuCfuU fuUfgscsc | 354 |
| AD-65079 | A-129970 | GfsusCfuGfuGfcUfGfGfcUf aUfaAfaGfaAfL96 | 268 | A-129971 | usUfscUfuUfaUfaGfccaGfcAfcA fgAfcscsa | 355 |

TABLE 4-continued

Modified Sense and Antisense Strand Sequences of KLKB1 dsRNAs

| Duplex Name | Sense Oligo Name | Sense Sequence 5' to 3' | SEQ ID NO: | Antisense Oligo Nmae | Antisense Sequence 5' to 3' | SEQ ID NO: |
|---|---|---|---|---|---|---|
| AD-65102 | A-129994 | AfsgsCfaGfuGfuUfGfAfaGfaAfuGfcCfaAfL96 | 269 | A-129995 | usUfsgGfcAfuUfcUfucaAfcAfcUfgCfusasa | 356 |
| AD-65138 | A-130190 | GfsusGfuGfuGfgAfGfGfgUfcAfcUfcAfuAfL96 | 270 | A-130191 | usAfsuGfaGfuGfaCfccuCfcAfcAfcAfcsgsu | 357 |
| AD-65075 | A-130000 | GfsasAfaAfgAfuGfCfUfuGfuAfaGfgGfaAfL96 | 271 | A-130001 | usUfscCfcUfuAfcAfagcAfuCfuUfuUfcscsc | 358 |
| AD-65080 | A-129986 | AfscsAfuCfuGfaAfAfGfuGfgCfaCfaCfcAfL96 | 272 | A-129987 | usGfsgUfgUfgCfcAfcuuUfcAfgAfuGfususu | 359 |
| AD-65145 | A-130208 | CfsusCfuGfuGfcUfGfGfcUfaUfaAfaGfaAfL96 | 273 | A-130209 | usUfscUfuUfaUfaGfccaGfcAfcAfgAfgscsa | 360 |
| AD-65169 | A-130232 | UfsgsCfaGfuGfuUfGfAfaGfaAfuGfcCfaAfL96 | 274 | A-130233 | usUfsgGfcAfuUfcUfucaAfcAfcUfgCfasasa | 361 |
| AD-65061 | A-129964 | UfsusCfuUfaAfaAfCfAfuCfuGfaAfaGfuAfL96 | 275 | A-129965 | usAfscUfuUfcAfgAfuguUfuUfaAfgAfasgsa | 362 |
| AD-65135 | A-130236 | UfsasGfcAfcAfaUfUfUfaUfaCfcAfaCfuAfL96 | 276 | A-130237 | usAfsgUfuGfgUfaUfaaaUfuGfuGfcUfasgsu | 363 |
| AD-65068 | A-129982 | UfsgsGfaAfuGfuGfGfCfgUfuUfgGfuGfgAfL96 | 277 | A-129983 | usCfscAfcCfaAfaCfgccAfcAfuUfcCfasusu | 364 |
| AD-65148 | A-130256 | CfscsAfaUfgUfgGfUfCfaUfcAfaAfuAfaAfL96 | 278 | A-130257 | usUfsuAfuUfuGfaUfgacCfaCfaUfuGfgsusu | 365 |
| AD-65072 | A-129954 | CfsusGfuGfuGfgAfGfGfgUfcAfcUfcAfuAfL96 | 279 | A-129955 | usAfsuGfaGfuGfaCfccuCfcAfcAfcAfgsgsu | 366 |
| AD-65146 | A-130224 | UfscsAfuCfuGfaAfAfGfuGfgCfaCfaCfcAfL96 | 280 | A-130225 | usGfsgUfgUfgCfcAfcuuUfcAfgAfuGfasusu | 367 |
| AD-65129 | A-130234 | CfscsAfcAfuUfAfUfAffUfaCfcAfuGfuUfL96 | 281 | A-130235 | asAfscAfgUfuGfgUfauaAfaUfuGfuGfgsusu | 368 |
| AD-65064 | A-130012 | CfsasCfaAfgCfaCfAfAfuUfuAfuAfcCfaAfL96 | 282 | A-130013 | usUfsgGfuAfuAfaAfuugUfgCfuUfgUfgsusc | 369 |
| AD-65134 | A-130220 | AfsgsGfaAfuGfuGfGfCfgUfuUfgGfuGfgAfL96 | 283 | A-130221 | usCfscAfcCfaAfaCfgccAfcAfuUfcCfususu | 370 |
| AD-65063 | A-129996 | GfscsAfcAfuUfAfUfAffUfaCfuGfuUfL96 | 284 | A-129997 | asAfscAfgUfuGfgUfauaAfaUfuGfuGfcsusu | 371 |
| AD-65089 | A-129944 | CfsgsCfaUfuGfuUfGfGfaGfgAfaCfaAfaAfL96 | 285 | A-129945 | usUfsuUfgUfuCfcUfccaAfcAfaUfgCfgsusg | 372 |
| AD-65069 | A-129998 | AfsasGfcAfcAfaUfUfUfaUfaCfcAfuAfL96 | 286 | A-129999 | usAfsgUfuGfgUfaUfaaaUfuGfuGfcUfusgsu | 373 |
| AD-65130 | A-130250 | GfsasCfaAfgCfaCfAfAfuUfuAfuAfcCfaAfL96 | 287 | A-130251 | usUfsgGfuAfuAfaAfuugUfgCfuUfgUfcsusc | 374 |
| AD-65147 | A-130240 | UfsusUfuAfcCfcGfGfGfaGfuUfgAfcUfuUfL96 | 288 | A-130241 | asAfsaGfuCfaAfcUfcccGfgGfuAfaAfasusu | 375 |
| AD-65081 | A-130002 | AfsusUfuAfcCfcGfGfGfaGfuUfgAfcUfuUfL96 | 289 | A-130003 | asAfsaGfuCfaAfcUfcccGfgGfuAfaAfususu | 376 |
| AD-65154 | A-130258 | UfscsAfcAfaGfcAfCfAfaUfuUfaUfaCfcAfL96 | 290 | A-130259 | usGfsgUfaUfaAfaUfuguGfcUfuGfuGfascsa | 377 |

TABLE 5

Human KLKB1 single dose screen using Dual-Glo Luciferase ® Assay

| Duplex ID | 10 nM Avg | 0.1 nM Avg | 10 nM SD | 0.1 nM_SD |
|---|---|---|---|---|
| AD-65077 | 15.04 | 36.85 | 1.97 | 0.94 |
| AD-65170 | 11.72 | 37.36 | 1.61 | 3.43 |
| AD-65103 | 11.77 | 40.29 | 1.72 | 2.58 |
| AD-65083 | 14.90 | 46.32 | 1.64 | 3.59 |
| AD-65087 | 14.83 | 47.05 | 0.93 | 3.15 |
| AD-65149 | 15.68 | 47.95 | 1.10 | 5.95 |
| AD-64652 | 17.40 | 48.15 | 0.98 | 2.10 |
| AD-65162 | 20.26 | 48.59 | 0.11 | 6.03 |
| AD-65153 | 13.45 | 49.10 | 0.80 | 3.51 |
| AD-65084 | 16.25 | 49.14 | 1.79 | 4.63 |
| AD-65099 | 14.44 | 49.82 | 2.09 | 1.40 |
| AD-65100 | 19.10 | 50.71 | 0.37 | 1.49 |
| AD-65090 | 18.90 | 50.81 | 1.95 | 7.82 |
| AD-65085 | 15.98 | 52.77 | 0.74 | 3.97 |
| AD-65062 | 16.20 | 54.87 | 0.06 | 3.28 |
| AD-65164 | 14.22 | 55.83 | 0.13 | 5.41 |
| AD-65139 | 14.30 | 56.04 | 0.82 | 4.47 |
| AD-65151 | 15.78 | 56.12 | 2.34 | 8.24 |
| AD-65158 | 22.09 | 56.30 | 2.11 | 4.24 |
| AD-65078 | 16.43 | 56.83 | 2.21 | 4.52 |
| AD-65161 | 20.86 | 56.93 | 1.98 | 2.35 |
| AD-65076 | 15.06 | 57.79 | 1.13 | 3.90 |
| AD-65093 | 18.51 | 58.48 | 1.65 | 2.72 |
| AD-65156 | 21.88 | 58.48 | 1.23 | 5.06 |
| AD-65059 | 23.66 | 59.20 | 2.39 | 9.41 |
| AD-65073 | 14.96 | 59.62 | 0.84 | 4.37 |
| AD-65074 | 20.38 | 59.64 | 1.70 | 4.26 |
| AD-65092 | 25.49 | 59.65 | 1.13 | 5.25 |
| AD-65097 | 16.10 | 59.84 | 1.05 | 6.04 |
| AD-65101 | 17.79 | 60.00 | 1.09 | 7.50 |
| AD-65131 | 26.32 | 60.83 | 3.13 | 4.22 |
| AD-65159 | 20.30 | 60.84 | 1.29 | 5.93 |
| AD-65150 | 26.14 | 60.87 | 2.74 | 5.87 |
| AD-65060 | 21.85 | 61.24 | 2.64 | 8.69 |
| AD-65098 | 21.82 | 61.42 | 1.59 | 2.06 |
| AD-65067 | 14.78 | 61.63 | 1.49 | 1.15 |
| AD-65065 | 30.49 | 61.91 | 1.08 | 3.88 |
| AD-65095 | 20.31 | 62.19 | 0.93 | 3.55 |
| AD-65126 | 22.68 | 62.58 | 2.00 | 3.65 |
| AD-65157 | 37.47 | 63.14 | 1.23 | 3.92 |
| AD-65086 | 32.28 | 63.19 | 2.00 | 6.01 |
| AD-65167 | 26.43 | 63.54 | 1.61 | 3.80 |
| AD-65071 | 26.58 | 64.16 | 2.30 | 2.64 |
| AD-65066 | 22.13 | 64.20 | 1.26 | 3.77 |
| AD-65165 | 21.89 | 64.31 | 2.14 | 3.57 |
| AD-65132 | 21.03 | 64.52 | 2.67 | 2.21 |
| AD-65125 | 25.73 | 64.78 | 3.64 | 10.30 |
| AD-65091 | 35.66 | 65.28 | 3.85 | 0.92 |
| AD-65136 | 19.19 | 65.74 | 1.46 | 2.65 |
| AD-65137 | 28.04 | 65.76 | 1.12 | 4.54 |
| AD-65140 | 27.71 | 65.90 | 2.52 | 2.03 |
| AD-65128 | 24.33 | 66.14 | 3.88 | 6.36 |
| AD-65088 | 38.37 | 66.28 | 0.75 | 4.58 |
| AD-65160 | 25.02 | 66.42 | 1.10 | 2.11 |
| AD-65152 | 48.65 | 66.46 | 2.84 | 2.02 |
| AD-65133 | 14.03 | 66.60 | 1.79 | 1.76 |
| AD-65082 | 28.29 | 66.66 | 3.48 | 4.83 |
| AD-65094 | 26.65 | 66.78 | 0.56 | 1.41 |
| AD-65155 | 40.50 | 66.99 | 2.70 | 1.23 |
| AD-65163 | 35.04 | 67.16 | 3.15 | 4.42 |
| AD-65144 | 22.23 | 67.27 | 1.79 | 0.87 |
| AD-65096 | 36.47 | 67.31 | 2.64 | 1.97 |
| AD-65142 | 19.07 | 67.32 | 3.01 | 1.34 |
| AD-65141 | 15.21 | 67.58 | 1.60 | 3.45 |
| AD-65079 | 29.27 | 67.76 | 2.80 | 3.80 |
| AD-65102 | 30.46 | 68.54 | 2.45 | 1.65 |
| AD-65138 | 41.51 | 68.68 | 2.13 | 5.34 |
| AD-65075 | 16.72 | 69.00 | 1.04 | 1.14 |
| AD-65080 | 36.41 | 69.03 | 4.21 | 3.96 |
| AD-65145 | 34.78 | 69.34 | 2.61 | 2.95 |
| AD-65169 | 30.06 | 69.63 | 2.17 | 4.29 |
| AD-65061 | 41.00 | 70.18 | 4.34 | 3.71 |
| AD-65135 | 67.86 | 70.58 | 2.28 | 5.97 |
| AD-65068 | 30.14 | 71.51 | 3.78 | 4.08 |
| AD-65148 | 37.81 | 71.67 | 7.51 | 2.54 |
| AD-65072 | 43.46 | 71.73 | 1.45 | 6.71 |
| AD-65146 | 55.99 | 71.80 | 5.50 | 3.07 |
| AD-65129 | 34.09 | 71.81 | 1.22 | 2.86 |
| AD-65064 | 37.23 | 71.84 | 4.61 | 2.50 |
| AD-65134 | 34.90 | 71.86 | 3.14 | 2.91 |
| AD-65063 | 32.52 | 72.21 | 2.92 | 4.47 |
| AD-65089 | 34.88 | 73.21 | 0.07 | 0.46 |
| AD-65069 | 59.34 | 73.27 | 4.47 | 4.89 |
| AD-65130 | 38.52 | 73.89 | 1.69 | 2.78 |
| AD-65147 | 69.27 | 76.69 | 7.33 | 4.28 |
| AD-65081 | 55.75 | 77.78 | 4.77 | 5.96 |
| AD-65154 | 45.69 | 79.81 | 2.01 | 7.82 |

TABLE 6

Mouse KLKB1 single dose screen using Dual-Glo Luciferase ® Assay

| Duplex ID | 10 nM Avg | 0.1 nM Avg | 10 nM SD | 0.1 nM_SD |
|---|---|---|---|---|
| AD-65077 | 8.67 | 44.09 | 0.45 | 0.12 |
| AD-65103 | 13.99 | 52.56 | 1.01 | 0.70 |
| AD-65087 | 11.03 | 55.15 | 0.53 | 0.44 |
| AD-65101 | 18.50 | 57.32 | 1.40 | 5.05 |
| AD-65151 | 13.94 | 58.04 | 0.90 | 1.91 |
| AD-65097 | 17.04 | 58.72 | 1.99 | 3.06 |
| AD-65170 | 25.69 | 59.35 | 1.72 | 3.72 |
| AD-65062 | 32.25 | 60.50 | 3.49 | 0.75 |
| AD-65064 | 34.48 | 61.67 | 1.44 | 0.10 |
| AD-65085 | 13.68 | 61.86 | 1.70 | 3.87 |
| AD-65063 | 17.43 | 61.92 | 1.12 | 2.56 |
| AD-65153 | 23.75 | 62.67 | 2.17 | 2.36 |
| AD-65089 | 30.93 | 62.79 | 0.75 | 2.15 |
| AD-65074 | 43.09 | 63.07 | 1.73 | 4.37 |
| AD-65067 | 18.02 | 63.49 | 2.41 | 2.86 |
| AD-65099 | 48.62 | 63.58 | 2.12 | 4.44 |
| AD-65091 | 67.51 | 64.14 | 8.48 | 2.38 |
| AD-65086 | 41.17 | 64.14 | 4.31 | 2.61 |
| AD-65059 | 75.31 | 64.20 | 2.59 | 3.27 |
| AD-65158 | 59.18 | 64.32 | 3.51 | 2.00 |
| AD-65095 | 65.59 | 64.35 | 6.12 | 5.81 |
| AD-65083 | 32.77 | 64.54 | 1.99 | 3.38 |
| AD-65169 | 66.29 | 64.54 | 3.45 | 4.37 |
| AD-65125 | 71.21 | 64.58 | 3.75 | 2.19 |
| AD-65141 | 34.27 | 64.65 | 2.11 | 5.10 |
| AD-65073 | 47.93 | 64.68 | 2.48 | 1.94 |
| AD-65142 | 49.73 | 64.74 | 4.36 | 5.42 |
| AD-65128 | 37.04 | 64.86 | 3.14 | 0.92 |
| AD-65075 | 34.53 | 65.38 | 3.98 | 1.48 |
| AD-65068 | 75.01 | 65.42 | 1.57 | 3.56 |
| AD-65148 | 54.43 | 65.52 | 3.04 | 1.57 |
| AD-65065 | 110.49 | 65.55 | 4.29 | 2.79 |
| AD-65071 | 54.17 | 65.62 | 3.09 | 2.92 |
| AD-65061 | 112.26 | 65.87 | 2.27 | 2.26 |
| AD-65060 | 63.69 | 65.90 | 5.04 | 0.97 |
| AD-65076 | 27.86 | 65.98 | 2.99 | 3.32 |
| AD-65098 | 51.86 | 66.08 | 3.95 | 6.10 |
| AD-64652 | 70.91 | 66.42 | 5.35 | 3.70 |
| AD-65154 | 65.58 | 66.44 | 3.77 | 1.79 |
| AD-65131 | 104.49 | 66.84 | 3.11 | 3.42 |
| AD-65152 | 46.64 | 66.91 | 2.11 | 2.46 |
| AD-65160 | 18.79 | 67.16 | 0.67 | 4.48 |
| AD-65133 | 23.73 | 67.16 | 1.62 | 3.56 |
| AD-65096 | 55.79 | 67.18 | 3.11 | 4.26 |
| AD-65163 | 62.97 | 67.20 | 4.28 | 0.88 |
| AD-65157 | 66.01 | 67.22 | 4.10 | 3.60 |
| AD-65092 | 51.19 | 67.53 | 3.56 | 1.95 |
| AD-65093 | 52.08 | 67.55 | 2.16 | 1.72 |
| AD-65130 | 57.52 | 67.76 | 6.66 | 1.12 |
| AD-65100 | 74.97 | 67.91 | 6.18 | 2.73 |
| AD-65102 | 63.88 | 67.94 | 2.90 | 2.22 |
| AD-65159 | 59.98 | 67.94 | 6.46 | 4.35 |
| AD-65165 | 62.31 | 67.95 | 1.86 | 3.06 |
| AD-65150 | 81.30 | 68.12 | 8.66 | 0.38 |
| AD-65164 | 34.95 | 68.44 | 0.63 | 3.58 |

TABLE 6-continued

Mouse KLKB1 single dose screen using Dual-Glo Luciferase ® Assay

| Duplex ID | 10 nM Avg | 0.1 nM Avg | 10 nM SD | 0.1 nM_SD |
|---|---|---|---|---|
| AD-65136 | 50.50 | 68.53 | 3.84 | 0.44 |
| AD-65161 | 71.46 | 68.64 | 3.85 | 1.88 |
| AD-65088 | 48.15 | 68.68 | 3.38 | 1.80 |
| AD-65134 | 68.99 | 68.91 | 2.75 | 1.56 |
| AD-65078 | 63.09 | 69.05 | 4.57 | 3.85 |
| AD-65129 | 18.28 | 69.24 | 1.92 | 0.72 |
| AD-65155 | 45.01 | 69.32 | 3.93 | 1.78 |
| AD-65079 | 47.09 | 69.38 | 0.79 | 3.42 |
| AD-65126 | 67.47 | 69.39 | 3.54 | 7.01 |
| AD-65144 | 65.85 | 69.71 | 2.58 | 4.73 |
| AD-65084 | 81.65 | 69.74 | 4.96 | 3.77 |
| AD-65162 | 74.13 | 69.80 | 5.71 | 3.24 |
| AD-65140 | 54.32 | 69.81 | 1.87 | 3.84 |
| AD-65139 | 46.64 | 69.97 | 6.00 | 2.50 |
| AD-65147 | 66.48 | 69.99 | 4.21 | 3.72 |
| AD-65069 | 67.61 | 70.00 | 2.85 | 2.74 |
| AD-65149 | 45.54 | 70.01 | 2.63 | 2.08 |
| AD-65072 | 73.76 | 70.21 | 3.59 | 1.93 |
| AD-65146 | 79.06 | 70.25 | 5.25 | 2.65 |
| AD-65145 | 41.44 | 70.43 | 1.00 | 3.89 |
| AD-65132 | 72.39 | 70.57 | 2.20 | 1.67 |
| AD-65090 | 112.31 | 70.73 | 6.67 | 2.16 |
| AD-65094 | 35.82 | 70.81 | 2.77 | 0.09 |
| AD-65066 | 75.47 | 70.83 | 3.28 | 4.93 |
| AD-65137 | 57.80 | 71.08 | 2.54 | 3.10 |
| AD-65081 | 62.66 | 71.12 | 4.17 | 6.09 |
| AD-65082 | 42.77 | 71.30 | 1.68 | 1.58 |
| AD-65138 | 72.87 | 71.49 | 1.82 | 2.34 |
| AD-65080 | 68.06 | 72.17 | 3.20 | 0.58 |
| AD-65167 | 73.30 | 72.47 | 5.89 | 3.39 |
| AD-65135 | 76.47 | 72.83 | 0.50 | 2.14 |
| AD-65156 | 104.49 | 73.62 | 4.93 | 2.80 |
| AD-65077 | 15.04 | 36.85 | 1.97 | 0.94 |
| AD-65170 | 11.72 | 37.36 | 1.61 | 3.43 |
| AD-65103 | 11.77 | 40.29 | 1.72 | 2.58 |

A subset of duplexes were also assayed for dose response for silencing human KLKB1 and mouse KLKB1 mRNA using the Dual-Glo® Luciferase assay, as described above. The results of the human KLKB1 screen in Cos 7 cells transfected with the indicated KLKB1 iRNAs are shown in Table 7. The results of the mouse KLKB1 screen in Cos 7 cells transfected with the indicated KLKB1 iRNAs are shown in Table 8. Data are expressed as percent of mRNA remaining relative to negative control at 48 hours.

TABLE 7

Human KLKB1 dose response screen in Cos7 cells using Dual-Glo Luciferase ® Assay

| Duplex ID | IC50 (nM) |
|---|---|
| AD-65077 | 0.0004 |
| AD-65170 | 0.0084 |
| AD-65103 | 0.0344 |
| AD-65083 | 0.0704 |
| AD-65087 | 0.0593 |
| AD-65149 | 0.0854 |
| AD-64652 | 0.123 |
| AD-65162 | 0.1323 |
| AD-65153 | 0.0683 |
| AD-65084 | 0.0987 |
| AD-65099 | 0.0211 |

TABLE 8

Mouse KLKB1 dose response screen in Cos7 cells using Dual-Glo Luciferase ® Assay

| Duplex ID | IC50 (nM) |
|---|---|
| AD-65077 | 0.0083 |
| AD-65170 | 0.206 |
| AD-65103 | 0.1216 |
| AD-65083 | 1.2257 |
| AD-65087 | 0.1381 |
| AD-65149 | 36.5482 |
| AD-64652 | N/A |
| AD-65162 | N/A |
| AD-65153 | 0.4234 |
| AD-65084 | N/A |
| AD-65099 | 246.7682 |

Example 3. F12 iRNA Synthesis

Source of Reagents

Where the source of a reagent is not specifically given herein, such reagent can be obtained from any supplier of reagents for molecular biology at a quality/purity standard for application in molecular biology.

Transcripts siRNA Design

A set of siRNAs targeting the human F12, "coagulation factor XII" (human: NCBI refseqID NM_000505; NCBI GeneID: 2161), as well as toxicology-species F12 orthologs (cynomolgus monkey: XM_005558647; mouse: NM_021489; rat, NM_001014006) were designed using custom R and Python scripts. The human F12 REFSEQ mRNA has a length of 2060 bases. The rationale and method for the set of siRNA designs is as follows: the predicted efficacy for every potential 19mer siRNA from position 50 through position 2060 (the coding region and 3' UTR) of human F12 mRNA (containing the coding region and 3' UTR) was determined using a linear model that predicted the direct measure of mRNA knockdown based on the data of more than 20,000 distinct siRNA designs targeting a large number of vertebrate genes. Subsets of the F12 siRNAs were designed with perfect or near-perfect matches between human, cynomolgus and rhesus monkey. A further subset was designed with perfect or near-perfect matches to mouse and rat F12 orthologs. For each strand of the siRNA, a custom Python script was used in a brute force search to measure the number and positions of mismatches between the siRNA and all potential alignments in the target species transcriptome. Extra weight was given to mismatches in the seed region, defined here as positions 2-9 of the antisense oligonucleotide, as well the cleavage site of the siRNA, defined here as positions 10-11 of the antisense oligonucleotide. The relative weights for the mismatches were 2.8 for seed mismatches, 1.2 for cleavage site mismatches, and 1 mismatches in other positions up through antisense position 19. Mismatches in the first position were ignored. A specificity score was calculated for each strand by summing the value of each weighted mismatch. Preference was given to siRNAs whose antisense score in human and cynomolgus monkey was >=3.0 and predicted efficacy was >=70% knockdown of the F12 transcript.

A detailed list of the unmodified F12 sense and antisense strand sequences is shown in Table 9. A detailed list of the modified F12 sense and antisense strand sequences is shown in Table 10.

siRNA Synthesis

F12 siRNA sequences were synthesized at 1 μmol scale on a Mermade 192 synthesizer (BioAutomation) using the solid support mediated phosphoramidite chemistry. The solid support was controlled pore glass (500 A) loaded with custom GalNAc ligand or universal solid support (AM biochemical). Ancillary synthesis reagents, 2'-F and 2'-O-Methyl RNA and deoxy phosphoramidites were obtained from Thermo-Fisher (Milwaukee, WI) and Hongene (China). 2'F 2'-O-Methyl, GNA (glycol nucleic acids), 5'phosphate and other modifications were introduced using the corresponding phosphoramidites. Synthesis of 3' GalNAc conjugated single strands was performed on a GalNAc modified CPG support. Custom CPG universal solid support was used for the synthesis of antisense single strands. Coupling time for all phosphoramidites (100 mM in acetonitrile) was 5 min employing 5-Ethylthio-1H-tetrazole (ETT) as activator (0.6 M in acetonitrile). Phosphorothioate linkages were generated using a 50 mM solution of 3-((Dimethylamino-methylidene) amino)-3H-1,2,4-dithiazole-3-thione (DDTT, obtained from Chemgenes (Wilmington, MA, USA)) in anhydrous acetonitrile/pyridine (1:1 v/v). Oxidation time was 3 minutes. All sequences were synthesized with final removal of the DMT group ("DMT off").

Upon completion of the solid phase synthesis, oligoribonucleotides were cleaved from the solid support and deprotected in sealed 96 deep well plates using 200 μL Aqueous Methylamine reagents at 60° C. for 20 minutes. For sequences containing 2' ribo residues (2'-OH) that are protected with a tert-butyl dimethyl silyl (TBDMS) group, a second step deprotection was performed using TEA·3HF (triethylamine trihydro fluoride) reagent. To the methylamine deprotection solution, 200 uL of dimethyl sulfoxide (DMSO) and 300 ul TEA. 3HF reagent was added and the solution was incubated for additional 20 min at 60° C. At the end of cleavage and deprotection step, the synthesis plate was allowed to come to room temperature and was precipitated by addition of 1 mL of acetontile:ethanol mixture (9:1). The plates were cooled at −80 C for 2 hrs, superanatant decanted carefully with the aid of a multi channel pipette. The oligonucleotide pellet was re-suspended in 20 mM NaOAc buffer and were desalted using a 5 mL HiTrap size exclusion column (GE Healthcare) on an AKTA Purifier System equipped with an A905 autosampler and a Frac 950 fraction collector. Desalted samples were collected in 96-well plates. Samples from each sequence were analyzed by LC-MS to confirm the identity, UV (260 nm) for quantification and a selected set of samples by IEX chromatography to determine purity.

Annealing of F12 single strands was performed on a Tecan liquid handling robot. Equimolar mixture of sense and antisense single strands were combined and annealed in 96 well plates. After combining the complementary single strands, the 96-well plate was sealed tightly and heated in an oven at 100° C. for 10 minutes and allowed to come slowly to room temperature over a period 2-3 hours. The concentration of each duplex was normalized to 10 μM in 1×PBS and then submitted for in vitro screening assays.

TABLE 9

Unmodified F12 Sequences

| Duplex name | sense oligo name | Sense Sequence 5' to 3' | SEQ ID NO: | antis oligo name | Antisense Sequence 5' to 3' | Position in NM_000505 | SEQ ID NO: |
|---|---|---|---|---|---|---|---|
| AD-66186 | A-132464 | GGUGAGCUUGGAGUCAACACU | 378 | A-132465 | AGUGUUGACUCCAAGCUCACCAG | 79_102 | 428 |
| AD-66157 | A-132406 | GAGCUUGGAGUCAACACUUUA | 379 | A-132407 | UAAAGUGUUGACUCCAAGCUCAC | 82_105 | 429 |
| AD-66118 | A-132326 | CUUGGAGUCAACACUUUCGAU | 380 | A-132327 | AUCGAAAGUGUUGACUCCAAGCU | 85_108 | 430 |
| AD-66115 | A-132320 | UUGGAGUCAACACUUUCGAUU | 381 | A-132321 | AAUCGAAAGUGUUGACUCCAAGC | 86_109 | 431 |
| AD-66170 | A-132432 | AACACUUUCGAUUCCACCUUA | 382 | A-132433 | UAAGGUGGAAUCGAAAGUGUUGA | 94_117 | 432 |
| AD-66166 | A-132424 | AGGAGCAUAAGUACAAAGCUA | 383 | A-132425 | UAGCUUUGUACUUAUGCUCCUUG | 126_149 | 433 |
| AD-66173 | A-132438 | GAGCAUAAGUACAAAGCUGAA | 384 | A-132439 | UUCAGCUUUGUACUUAUGCUCCU | 128_151 | 434 |
| AD-66177 | A-132446 | UAAGUACAAAGCUGAAGAGCA | 385 | A-132447 | UGCUCUUCAGCUUUGUACUUAUG | 133_156 | 435 |
| AD-66161 | A-132414 | AAGUACAAAGCUGAAGAGCAA | 386 | A-132415 | UUGCUCUUCAGCUUUGUACUUAU | 134_157 | 436 |
| AD-66114 | A-132318 | UACCACAAAUGUACCCACAAA | 387 | A-132319 | UUUGUGGGUACAUUUGUGGUACA | 218_241 | 437 |
| AD-66179 | A-132450 | CCACAAAUGUACCCACAAGGA | 388 | A-132451 | UCCUUGUGGGUACAUUUGUGGUA | 220_243 | 438 |
| AD-66160 | A-132412 | UACUGUUUGGAGCCCAAGAAA | 389 | A-132413 | UUUCUUGGGCUCCAAACAGUAUC | 305_328 | 439 |
| AD-66171 | A-132434 | ACUGUUUGGAGCCCAAGAAAA | 390 | A-132435 | UUUUCUUGGGCUCCAAACAGUAU | 306_329 | 440 |
| AD-66189 | A-132470 | CUGUUUGGAGCCCAAGAAAGU | 391 | A-132471 | ACUUUCUUGGGCUCCAAACAGUA | 307_330 | 441 |
| AD-66122 | A-132334 | GGAGCCCAAGAAAGUGAAAGA | 392 | A-132335 | UCUUUCACUUUCUUGGGCUCCAA | 313_336 | 442 |
| AD-66176 | A-132444 | GAGCCCAAGAAAGUGAAAGAA | 393 | A-132445 | UUCUUUCACUUUCUUGGGCUCCA | 314_337 | 443 |
| AD-66125 | A-132340 | AGCCCAAGAAAGUGAAAGACA | 394 | A-132341 | UGUCUUUCACUUUCUUGGGCUCC | 315_338 | 444 |
| AD-66112 | A-132314 | GCCCAAGAAAGUGAAAGACCA | 395 | A-132315 | UGGUCUUUCACUUUCUUGGGCUC | 316_339 | 445 |
| AD-66172 | A-132436 | CCCAAGAAAGUGAAAGACCAA | 396 | A-132437 | UUGGUCUUUCACUUUCUUGGGCU | 317_340 | 446 |

TABLE 9-continued

Unmodified F12 Sequences

| Duplex name | sense oligo name | Sense Sequence 5' to 3' | SEQ ID NO: | antis oligo name | Antisense Sequence 5' to 3' | Position in NM_000505 | SEQ ID NO: |
|---|---|---|---|---|---|---|---|
| AD-66127 | A-132344 | CAAGAAAGUGAAAGACCAUUA | 397 | A-132345 | UAAUGGUCUUUCACUUUCUUGGG | 319_342 | 447 |
| AD-66162 | A-132416 | GAAAGUGAAAGACCACUGCAA | 398 | A-132417 | UUGCAGUGGUCUUUCACUUUCUU | 322_345 | 448 |
| AD-66181 | A-132454 | AAAGUGAAAGACCACUGCAGA | 399 | A-132455 | UCUGCAGUGGUCUUUCACUUUCU | 323_346 | 449 |
| AD-66184 | A-132460 | UCACUGGAAACCACUGCCAGA | 400 | A-132461 | UCUGGCAGUGGUUUCCAGUGAGG | 420_443 | 450 |
| AD-66182 | A-132456 | ACUGCCAGAAAGAGAAGUGCU | 401 | A-132457 | AGCACUUCUCUUUCUGGCAGUGG | 432_455 | 451 |
| AD-66167 | A-132426 | CUGCCAGAAAGAGAAGUGCUU | 402 | A-132427 | AAGCACUUCUCUUUCUGGCAGUG | 433_456 | 452 |
| AD-66165 | A-132422 | CAGAAAGAGAAGUGCUUUGAA | 403 | A-132423 | UUCAAAGCACUUCUCUUUCUGGC | 437_460 | 453 |
| AD-66155 | A-132402 | AGAAAGAGAAGUGCUUUGAGA | 404 | A-132403 | UCUCAAAGCACUUCUCUUUCUGG | 438_461 | 454 |
| AD-66159 | A-132410 | AGUGCUUUGAGCCUCAGCUUA | 405 | A-132411 | UAAGCUGAGGCUCAAAGCACUUC | 447_470 | 455 |
| AD-66168 | A-132428 | UUCCACAAGAAUGAGAUAUGA | 406 | A-132429 | UCAUAUCUCAUUCUUGUGGAAAA | 476_499 | 456 |
| AD-66185 | A-132462 | UCCACAAGAAUGAGAUAUGGU | 407 | A-132463 | ACCAUAUCUCAUUCUUGUGGAAA | 477_500 | 457 |
| AD-66156 | A-132404 | CCACAAGAAUGAGAUAUGGUA | 408 | A-132405 | UACCAUAUCUCAUUCUUGUGGAA | 478_501 | 458 |
| AD-66113 | A-132316 | AAGAAUGAGAUAUGGUAUAGA | 409 | A-132317 | UCUAUACCAUAUCUCAUUCUUGU | 482_505 | 459 |
| AD-66188 | A-132468 | UGGUAUAGAACUGAGCAAGCA | 410 | A-132469 | UGCUUGCUCAGUUCUAUACCAUA | 494_517 | 460 |
| AD-66190 | A-132472 | GUAUAGAACUGAGCAAGCAGA | 411 | A-132473 | UCUGCUUGCUCAGUUCUAUACCA | 496_519 | 461 |
| AD-66180 | A-132452 | AUAGAACUGAGCAAGCAGCUA | 412 | A-132453 | UAGCUGCUUGCUCAGUUCUAUAC | 498_521 | 462 |
| AD-66117 | A-132324 | CCAGAUGCCAGUGCAAGGGUA | 413 | A-132325 | UACCCUUGCACUGGCAUCUGGCC | 522_545 | 463 |
| AD-66169 | A-132430 | GCCAGUGCAAGGGUCCUGAUA | 414 | A-132431 | UAUCAGGACCCUUGCACUGGCAU | 528_551 | 464 |
| AD-66174 | A-132440 | CAGUGCAAGGGUCCUGAUGCA | 415 | A-132441 | UGCAUCAGGACCCUUGCACUGGC | 530_553 | 465 |
| AD-66175 | A-132442 | ACCAAGGCAAGCUGCUAUGAU | 416 | A-132443 | AUCAUAGCAGCUUGCCUUGGUGU | 683_706 | 466 |
| AD-66158 | A-132408 | CCAAGGCAAGCUGCUAUGAUA | 417 | A-132409 | UAUCAUAGCAGCUUGCCUUGGUG | 684_707 | 467 |
| AD-66119 | A-132328 | AGGCUUCAUGUCCCACUCAUA | 418 | A-132329 | UAUGAGUGGGACAUGAAGCCUAG | 974_997 | 468 |
| AD-66187 | A-132466 | GGCUCCGCAAGAGUCUGUCUU | 419 | A-132467 | AAGACAGACUCUUGCGGAGCCGC | 1131_1154 | 469 |
| AD-66163 | A-132418 | GCUCCGCAAGAGUCUGUCUUA | 420 | A-132419 | UAAGACAGACUCUUGCGGAGCCG | 1132_1155 | 470 |
| AD-66116 | A-132322 | CCGCAAGAGUCUGUCUUCGAU | 421 | A-132323 | AUCGAAGACAGACUCUUGCGGAG | 1135_1158 | 471 |
| AD-66137 | A-132364 | GUUCGAGGGGCUGAAGAAUA | 422 | A-132365 | UAUUCUUCAGCCCCCUCGAACUG | 1570_1593 | 472 |
| AD-66183 | A-132458 | GGAAGGCAAGAUUGUGUCCCA | 423 | A-132459 | UGGGACACAAUCUUGCCUUCCAU | 1956_1979 | 473 |
| AD-66164 | A-132420 | AGGCAAGAUUGUGUCCCAUUA | 424 | A-132421 | UAAUGGGACACAAUCUUGCCUUC | 1959_1982 | 474 |
| AD-66121 | A-132332 | AACUCAAUAAAGUGCUUUGAA | 425 | A-132333 | UUCAAAGCACUUUAUUGAGUUUC | 2017_2040 | 475 |
| AD-66126 | A-132342 | AAUAAAGUGCUUUGAAAACGU | 426 | A-132343 | ACGUUUUCAAAGCACUUUAUUGA | 2022_2045 | 476 |
| AD-66178 | A-132448 | AGUGCUUUGAAAAUGCUGAGA | 427 | A-132449 | UCUCAGCAUUUUCAAAGCACUUU | 2027_2050 | 477 |

TABLE 10

Modified F12 Sequences

| Duplex name | sense oligo name | Sense Sequence 5' to 3' | SEQ ID NO: | antis oligo name | Antisense Sequence 5' to 3' | SEQ ID NO: |
|---|---|---|---|---|---|---|
| AD-66186 | A-132464 | GfsgsUfgAfgCfuUfGfGfaGfuCfaAfcAfcUfL96 | 478 | A-132465 | asGfsuGfuUfgAfcUfccaAfgCfuCfaCfcsasg | 528 |
| AD-66157 | A-132406 | GfsasGfcUfuGfgAfGfUfcAfaCfaCfuUfuAfL96 | 479 | A-132407 | usAfsaAfgUfgUfuGfacuCfcAfaGfcUfcsasc | 529 |
| AD-66118 | A-132326 | CfsusUfgGfaGfuCfAfAfcAfcUfuUfcGfaUfL96 | 480 | A-132327 | asUfscGfaAfaGfuGfuugAfcUfcCfaAfgscsu | 530 |
| AD-66115 | A-132320 | UfsusGfgAfgUfcAfAfCfaCfuUfuCfgAfuUfL96 | 481 | A-132321 | asAfsuCfgAfaAfgUfguuGfaCfuCfcAfasgsc | 531 |
| AD-66170 | A-132432 | AfsasCfaCfuUfuCfGfAfuUfcCfaCfcUfuAfL96 | 482 | A-132433 | usAfsaGfuUfgGfaAfucgAfaAfgUfgUfusgsa | 532 |
| AD-66166 | A-132424 | AfsgsGfaGfcAfuAfAfGfuAfcAfaAfgCfuAfL96 | 483 | A-132425 | usAfsgCfuUfuGfuAfcuuAfuGfcUfcCfususg | 533 |
| AD-66173 | A-132438 | GfsasGfcAfuAfaGfUfAfcAfaAfgCfuGfaAfL96 | 484 | A-132439 | usUfscAfgCfuUfuGfuacUfuAfuGfcUfcscsu | 534 |
| AD-66177 | A-132446 | UfsasAfgUfaCfaAfAfGfcUfgAfaGfaGfcAfL96 | 485 | A-132447 | usGfscUfcUfuCfaGfcuuUfgUfaCfuUfasusg | 535 |
| AD-66161 | A-132414 | AfsasGfuAfcAfaAfGfCfuGfaAfgAfgCfaAfL96 | 486 | A-132415 | usUfsgCfuCfuUfcAfgcUfuUfgUfAfcUfusasu | 536 |
| AD-66114 | A-132318 | UfsasCfcAfcAfaAfUfGfuAfcCfcAfcAfaAfL96 | 487 | A-132319 | usUfsuGfuGfgGfuAfcauUfuGfuGfgUfascsa | 537 |
| AD-66179 | A-132450 | CfscsAfcAfaAfuGfUfUfaCfcAfcAfaGfaAfL96 | 488 | A-132451 | usCfscUfuGfuGfgUfacAfuUfuGfuGfgsusa | 538 |
| AD-66160 | A-132412 | UfsasCfuGfuUfuGfGfaFfgCfcCfaAfgAfaAfL96 | 489 | A-132413 | usUfsuCfuUfgGfgCfuccAfaAfcAfgUfasusc | 539 |
| AD-66171 | A-132434 | AfscsUfgUfuUfgGfAfGfcCfcAfaGfaAfaAfL96 | 490 | A-132435 | usUfsuUfcUfuGfgGfcucCfaAfaCfaGfusasu | 540 |
| AD-66189 | A-132470 | CfsusGfuUfuGfgAfGfGfcCfcAfaGfaAfgUfL96 | 491 | A-132471 | asCfsuUfcUfuGfgGfcuCfcAfaAfcAfgsusa | 541 |
| AD-66122 | A-132334 | GfsgsAfgCfcCfaAfGfAfaAfgUfgAfaAfgAfL96 | 492 | A-132335 | usCfsuUfuCfaCfuUfucuUfgGfgCfuCfcsasa | 542 |
| AD-66176 | A-132444 | GfsasGfcCfcAfaGfAfAfaGfuGfaAfaGfaAfL96 | 493 | A-132445 | usUfscUfuUfcAfcUfuucUfuGfgGfcUfcscsa | 543 |
| AD-66125 | A-132340 | AfsgsCfcCfaAfgAfAfAfgUfgAfaAfgAfcAfL96 | 494 | A-132341 | usGfsuCfuUfuCfaCfuuuCfuUfgGfgCfuscsc | 544 |
| AD-66112 | A-132314 | GfscsCfcAfaGfaAfAfGfuGfaAfaGfaCfaAfL96 | 495 | A-132315 | usGfsgUfcUfuUfcAfcuuUfcUfuGfgGfcsusc | 545 |
| AD-66172 | A-132436 | CfscsCfaAfgAfaAfGfUfgAfaAfgAfcCfaAfL96 | 496 | A-132437 | usUfsgGfuCfuUfuCfacUfuCfuUfgGfgscsu | 546 |
| AD-66127 | A-132344 | CfsasAfgAfaAfgUfGfAfaAfgAfcCfaUfuAfL96 | 497 | A-132345 | usAfsaUfgGfuCfuUfucaCfuUfuCfuUfgsgsg | 547 |
| AD-66162 | A-132416 | GfsasAfaGfuGfaAfAfGfaCfcAfuUfgCfaAfL96 | 498 | A-132417 | usUfsgCfaAfuGfgUfcuuUfcAfcUfuUfcsusu | 548 |
| AD-66181 | A-132454 | AfsasAfgUfgAfaAfGfGfcCfaUfuGfcAfgAfL96 | 499 | A-132455 | usCfsuGfcAfaUfgGfucuUfuCfaCfuUfuscsu | 549 |
| AD-66184 | A-132460 | UfscsAfcUfgGfaAfAfFfcAfcUfgCfcAfgAfL96 | 500 | A-132461 | usCfsuGfgCfaGfuGfuuUfcCfaGfuGfasgsg | 550 |
| AD-66167 | A-132426 | CfsusGfcCfaGfaAfAfFfgAfgFfaAfgUfcUfL96 | 502 | A-132427 | asAfsgCfaCfuUfcUfcuuUfcUfgGfcAfgsusg | 552 |
| AD-66165 | A-132422 | CfsasGfaAfaGfaGfAfAfgUfgCfuUfuGfaAfL96 | 503 | A-132423 | usUfscAfaAfgCfaCfuucUfcUfuUfcUfgsgsc | 553 |

TABLE 10-continued

Modified F12 Sequences

| Duplex name | sense oligo name | Sense Sequence 5' to 3' | SEQ ID NO: | antis oligo name | Antisense Sequence 5' to 3' | SEQ ID NO: |
|---|---|---|---|---|---|---|
| AD-66155 | A-132402 | AfsgsAfaAfgAfgAfAfGfuGf cUfuUfgAfgAfL96 | 504 | A-132403 | usCfsuCfaAfaAfGfcAfcuuCfuCfuU fuCfusgsg | 554 |
| AD-66159 | A-132410 | AfsgsUfgCfuUfuGfAfgGfcCf uCfaGfcUfuAfL96 | 505 | A-132411 | usAfsaGfcUfgAfgGfcucAfaAfgC faCfususc | 555 |
| AD-66168 | A-132428 | UfsusCfcAfcAfaGfAfAfuGf aGfaUfaUfgAfL96 | 506 | A-132429 | usCfsaUfaUfcUfcAfuucUfuGfuG fgAfasasa | 556 |
| AD-66185 | A-132462 | UfscsCfaCfaAfgAfAfUfgAf gAfuAfuGfgUfL96 | 507 | A-132463 | asCfsAfuAfuCfuCfauuCfuUfgU fgGfasasa | 557 |
| AD-66156 | A-132404 | CfscsAfcAfaGfaAfUfGfaGf aUfaUfgGfuAfL96 | 508 | A-132405 | usAfscCfaUfaUfcUfcauUfcUfuG fuGfgsasa | 558 |
| AD-66113 | A-132316 | AfsasGfaAfuGfaGfAfUfaUf gGfuAfuAfgAfL96 | 509 | A-132317 | usCfsuAfuAfcCfaUfaucUfcAfuU fcUfusgsu | 559 |
| AD-66188 | A-132468 | UfsgsGfuAfuAfgAfAfCfuGf aGfcAfaGfcAfL96 | 510 | A-132469 | usGfscUfgUfcUfcAfguuCfuAfuA fcCfasusa | 560 |
| AD-66190 | A-132472 | GfsusAfuAfgAfaCfUfGfaGf cAfaGfcAfgAfL96 | 511 | A-132473 | usCfsuGfcUfuGfcUfcagUfuCfuA fuAfcscsa | 561 |
| AD-66180 | A-132452 | AfsusAfgAfaCfuGfAfGfcAf aGfcAfgCfuAfL96 | 512 | A-132453 | usAfsgCfuGfcUfugcAfgUfuC fuAfusasc | 562 |
| AD-66117 | A-132324 | CfscsAfgAfuGfcCfAfGfuGf cAfaGfgGfuAfL96 | 513 | A-132325 | usAfscCfcUfuGfcAfcugGfcAfuC fuGfgscsc | 563 |
| AD-66169 | A-132430 | GfscsCfaGfuGfcAfAfGfgGf uCfcUfgAfuAfL96 | 514 | A-132431 | usAfsuCfaGfgAfcCfcuuGfcAfcU fgGfcsasu | 564 |
| AD-66174 | A-132440 | CfsasGfuGfcAfaGfGfGfuCf cUfgAfuGfcAfL96 | 515 | A-132441 | usGfscAfuCfaGfgAfcccUfuGfcA fcUfgsgsc | 565 |
| AD-66175 | A-132442 | AfscsCfaAfgGfcAfAfGfcUf gCfuAfuGfaUfL96 | 516 | A-132443 | asUfscAfuAfgCfaGfcuuGfcCfuU fgGfusgsu | 566 |
| AD-66158 | A-132408 | CfscsAfaGfgCfaAfGfCfuGf cUfaUfgAfuAfL96 | 517 | A-132409 | usAfsuCfaUfaGfcAfgcuUfgCfcU fuGfgsusg | 567 |
| AD-66119 | A-132328 | AfsgsGfcUfuCfaUfGfuUfcCf cAfcUfcAfuAfL96 | 518 | A-132329 | usAfsuGfaGfuGfgGfacaUfgAfaG fcCfusasg | 568 |
| AD-66187 | A-132466 | GfsgsCfuCfcGfcAfAfGfaGf uCfuGfuCfuUfL96 | 519 | A-132467 | asAfsgAfcAfgAfcUfcuuGfcGfgA fgCfcsgsc | 569 |
| AD-66163 | A-132418 | GfscsUfcCfgCfaAfGfAfgUf cUfgUfcUfuAfL96 | 520 | A-132419 | usAfsaGfaCfaGfaCfucuUfgCfgG faGfcscsg | 570 |
| AD-66116 | A-132322 | CfscsGfcAfaGfaGfUfCfuGf uCfuUfcGfaUfL96 | 521 | A-132323 | asUfscGfaAfgAfcAfgacUfcUfuG fcGfgsasg | 571 |
| AD-66137 | A-132364 | GfsusUfcGfaGfgGfGfGfcUf gAfaGfaAfuAfL96 | 522 | A-132365 | usAfsuUfcUfuCfaGfcccCfcUfcG faAfcsusg | 572 |
| AD-66183 | A-132458 | GfsgsAfaGfgCfaAfGfGfuUf gUfgUfcCfcAfL96 | 523 | A-132459 | usGfsgGfaCfaCfaAfcuUfgCfcU fuCfcsasu | 573 |
| AD-66164 | A-132420 | AfsgsGfcAfaGfaUfUfGfuGf uCfcCfaUfuAfL96 | 524 | A-132421 | usAfsaUfgGfgAfcAfcaaUfcUfuG fcCfususc | 574 |
| AD-66121 | A-132332 | AfsasCfuCfaAfuAfAfAfgUf gCfuUfuGfaAfL96 | 525 | A-132333 | usUfscAfaAfgCfaCfuuuAfuUfgA fgUffususc | 575 |
| AD-66126 | A-132342 | AfsasUfaAfaGfuGfCfUfuUf gAfaAfCfgUfL96 | 526 | A-132343 | asCfsgUfuUfuCfaAfagcAfcUfuU faUfusgsa | 576 |
| AD-66178 | A-132448 | AfsgsUfgCfuUfuGfAfAfaAf uGfcUfgAfgAfL96 | 527 | A-132449 | usCfsuCfaGfcAfuUfuucAfaAfgC faCfususu | 577 |

Example 4. In Vitro Screening of F12 siRNA Duplexes

Cell Culture and Transfections

Hep3b or Primary Mouse Hepatocyte cells (PMH) (MSCP10, Lot #MC613) were transfected by adding 4.9 μl of Opti-MEM plus 0.1 μl of Lipofectamine RNAiMax per well (Invitrogen, Carlsbad CA. cat #13778-150) to 5 μl of siRNA duplexes per well into a 384-well plate and incubated at room temperature for 15 minutes. Forty μl of DMEM (Hep3b) of William's E Medium (PMH) containing about $5 \times 10^3$ cells was then added to the siRNA mixture. Cells were incubated for 24 hours prior to RNA purification.

Single dose experiments were performed at 10 nM and 0.01 nM final duplex concentration and dose response experiments were done over a range of doses from 10 nM to 36 fM final duplex concentration over 8, 6-fold dilutions.

Total RNA Isolation Using DYNABEADS mRNA Isolation Kit:

RNA was isolated using an automated protocol on a BioTek-EL406 platform using DYNABEADs (Invitrogen, cat #61012). Briefly, 50 μl of Lysis/Binding Buffer and 25 μl of lysis buffer containing 3 μl of magnetic beads were added to the plate with cells. Plates were incubated on an electromagnetic shaker for 10 minutes at room temperature and then magnetic beads were captured and the supernatant was removed. Bead-bound RNA was then washed 2 times with 150 μl Wash Buffer A and once with Wash Buffer B. Beads were then washed with 150 μl Elution Buffer, re-captured and the supernatant was removed.

cDNA Synthesis Using ABI High Capacity cDNA Reverse Transcription Kit (Applied Biosystems, Foster City, CA, Cat #4368813):

Ten μl of a master mix containing 1 μl 10× Buffer, 0.4 μl 25× dNTPs, 1 μl 10× Random primers, 0.5 μl Reverse Transcriptase, 0.5 μl RNase inhibitor and 6.6 μl of H2O per reaction was added to RNA isolated as described above. Plates were sealed, mixed, and incubated on an electromagnetic shaker for 10 minutes at room temperature, followed by 2 hours 37° C. Plates were then incubated at 81° C. for 8 minutes.

Real Time PCR:

Two μl of cDNA were added to a master mix containing 0.5 μl of GAPDH TaqMan Probe (Hs99999905_m1 or 4352339E), 0.5 μl F12 probe (Hs00166821 or Mm00491349) and 5 μl Lightcycler 480 probe master mix (Roche Cat #04887301001) per well in a 384 well plates (Roche cat #04887301001). Real time PCR was performed using a LightCycler480 Real Time PCR system (Roche) using the ΔΔCt(RQ) assay. Each duplex was tested in four independent transfections.

To calculate relative fold change, real time data were analyzed using the ΔΔCt method and normalized to assays performed with cells transfected with 10 nM AD-1955, or mock transfected cells. $IC_{50}$s were calculated using a 4 parameter fit model using XLFit and normalized to cells transfected with AD-1955, a non-targeting control, or naïve cells.

The sense and antisense sequences of AD-1955 are:

```
SENSE:
                                (SEQ ID NO: 2343)
cuuAcGcuGAGuAcuucGAdTsdT;

ANTISENSE:
                                (SEQ ID NO: 2344)
UCGAAGuACUcAGCGuAAGdTsdT.
```

Table 11 shows the results of a single dose screen in Hep3b cells transfected with the indicated human F12 iRNAs. Table 12 shows the results of a single dose response screen in Hep3b cells transfected with the indicated human F12 iRNAs. Table 13 shows the results of a single dose screen in primary mouse hepatocytes transfected with the indicated mouse F12 iRNAs. Table 14 shows the results of a dose response screen in primary mouse hepatocytes transfected with the indicated human F12 iRNAs. Data are expressed as percent of mRNA remaining relative to AD-1955.

TABLE 11

F12 Single Dose Screen in Hep3bCells

| Duplex ID | 10 nM Avg | 0.1 nM Avg | 10 nM STDEV | 0.1 nM STDEV |
|---|---|---|---|---|
| AD-66186 | 33.1 | 88.4 | 5.3 | 12.6 |
| AD-66157 | 62.2 | 85.3 | 9.6 | 13.2 |
| AD-66118 | 47.4 | 59.4 | 2.9 | 10.6 |
| AD-66115 | 54.8 | 73.9 | 4.8 | 3 |
| AD-66170 | 31.6 | 57.3 | 3.9 | 12.5 |
| AD-66166 | 74.7 | 88.8 | 14.3 | 15.8 |
| AD-66173 | 22.3 | 58.5 | 7.6 | 11.8 |
| AD-66177 | 52.9 | 86.7 | 6.9 | 6.3 |
| AD-66161 | 50.3 | 59.9 | 7.9 | 10 |
| AD-66114 | 42.1 | 82.3 | 5.3 | 8.5 |
| AD-66179 | 78.4 | 101.4 | 14.3 | 16.1 |
| AD-66160 | 45.4 | 82.3 | 13.4 | 18.5 |
| AD-66171 | 74.8 | 126.2 | 12.1 | 28.2 |
| AD-66189 | 49.3 | 78.1 | 16.6 | 9.1 |
| AD-66122 | 47.2 | 94.9 | 7.4 | 7.5 |
| AD-66176 | 42.7 | 69.4 | 5.2 | 7 |
| AD-66125 | 46 | 91.8 | 7.5 | 17.4 |
| AD-66112 | 60.4 | 136.8 | 11.4 | 14.4 |
| AD-66172 | 34.9 | 70.2 | 13.1 | 11.1 |
| AD-66127 | 39.5 | 73.3 | 8.5 | 12.4 |
| AD-66162 | 79.1 | 93.6 | 13 | 24.7 |
| AD-66181 | 59.8 | 101.7 | 1.2 | 5.4 |
| AD-66184 | 34 | 72.9 | 7.8 | 14.9 |
| AD-66182 | 47 | 101 | 8.8 | 7.9 |
| AD-66167 | 30.3 | 60.2 | 2.6 | 5.9 |
| AD-66165 | 44.3 | 63.2 | 11.4 | 22.3 |
| AD-66155 | 45.3 | 72.8 | 13.5 | 16.1 |
| AD-66159 | 49.6 | 98 | 8.4 | 31.2 |
| AD-66168 | 25.5 | 52.9 | 5.8 | 16.6 |
| AD-66185 | 40.8 | 81.7 | 3.8 | 11.5 |
| AD-66156 | 30.8 | 75.6 | 4.4 | 5.4 |
| AD-66113 | 42.1 | 76 | 8.1 | 5.9 |
| AD-66188 | 43.9 | 82.1 | 9.1 | 15.4 |
| AD-66190 | 40.2 | 74.9 | 9 | 8.3 |
| AD-66180 | 34.6 | 83.1 | 6.6 | 23.3 |
| AD-66117 | 48.9 | 108.1 | 4.1 | 9.5 |
| AD-66169 | 64.9 | 89.4 | 9.8 | 1.9 |
| AD-66174 | 55.4 | 107.6 | 7.9 | 23 |
| AD-66175 | 37.9 | 104.7 | 4 | 19.7 |
| AD-66158 | 55 | 107.3 | 14.7 | 31.7 |
| AD-66119 | 27.6 | 69.8 | 3.4 | 4.3 |
| AD-66187 | 53.3 | 105 | 19.6 | 9.6 |
| AD-66163 | 33.6 | 53.9 | 5.1 | 4.9 |
| AD-66116 | 33.9 | 57.4 | 10.4 | 12.6 |
| AD-66137 | 103.4 | 136.7 | 6.6 | 15.9 |
| AD-66183 | 36.5 | 91.9 | 8 | 12.7 |
| AD-66164 | 31.3 | 78.2 | 5.1 | 6.4 |
| AD-66121 | 26.5 | 72.1 | 2.7 | 18.3 |
| AD-66126 | 33.2 | 56.7 | 2.6 | 12.6 |
| AD-66178 | 51.1 | 72.1 | 6.3 | 16.5 |

TABLE 12

F12 Dose Response Screen in Hep3b Cells

| DuplexId | IC$_{50}$ (nM) |
|---|---|
| AD-66170 | 0.085 |
| AD-66173 | 0.244 |
| AD-66176 | N/A |
| AD-66125 | N/A |
| AD-66172 | 0.398 |
| AD-66167 | 0.457 |
| AD-66165 | 0.058 |
| AD-66168 | 0.657 |
| AD-66163 | 0.481 |
| AD-66116 | 0.089 |
| AD-66126 | 0.086 |

TABLE 13

F12 Single Dose Screen in Primary Mouse Hepatocytes

| Duplex ID | 10 nM AVG | 0.1 nM AVG | 10 nM STDEV | 0.1 nM STDEV |
|---|---|---|---|---|
| AD-66186 | 93.1 | 102.6 | 2 | 6.6 |
| AD-66157 | 97.4 | 114.5 | 16.5 | 17 |
| AD-66118 | 65.9 | 93 | 11.6 | 11.9 |
| AD-66115 | 61.8 | 89 | 5.5 | 8.9 |
| AD-66170 | 88 | 98.5 | 11.7 | 8.4 |
| AD-66166 | 106.8 | 98.5 | 8.8 | 5.2 |
| AD-66173 | 106.8 | 106 | 11.2 | 14.8 |
| AD-66177 | 87.5 | 103 | 3.6 | 3.2 |
| AD-66161 | 94.4 | 103.1 | 7 | 15.9 |
| AD-66114 | 38.6 | 79.1 | 4.1 | 5 |
| AD-66179 | 71.1 | 105.7 | 6.8 | 18.2 |
| AD-66160 | 14.6 | 106.8 | 1.2 | 8.7 |
| AD-66171 | 17.7 | 102.5 | 2.3 | 6.1 |
| AD-66189 | 9.1 | 90.2 | 1.3 | 6.1 |
| AD-66122 | 14.4 | 95.7 | 0.7 | 13.9 |
| AD-66176 | 10.9 | 85.8 | 2.1 | 4.6 |
| AD-66125 | 12.6 | 80.5 | 2.1 | 6.2 |
| AD-66112 | 19.1 | 82 | 7.2 | 3.5 |
| AD-66172 | 4.2 | 75.3 | 0.4 | 6.7 |
| AD-66127 | 7.4 | 48.4 | 3.7 | 7.3 |
| AD-66162 | 3.9 | 30.6 | 1.9 | 4.9 |
| AD-66181 | 7.2 | 69.2 | 0.9 | 4.1 |
| AD-66184 | 93.6 | 110.9 | 4.1 | 6.8 |
| AD-66182 | 13.4 | 89.9 | 1.3 | 2 |
| AD-66167 | 4.8 | 55.5 | 0.5 | 2.6 |
| AD-66165 | 2.1 | 18.7 | 0.3 | 3.6 |
| AD-66155 | 5.7 | 48 | 0.7 | 5.1 |
| AD-66159 | 7.2 | 88.7 | 0.5 | 3.7 |
| AD-66168 | 65.6 | 105.6 | 1.6 | 11.3 |
| AD-66185 | 96 | 108.9 | 3.1 | 16 |
| AD-66156 | 56.8 | 107.2 | 3.5 | 8.8 |
| AD-66113 | 72.8 | 88.7 | 4.8 | 5.5 |
| AD-66188 | 117.5 | 95.5 | 17.3 | 4.9 |
| AD-66190 | 118.3 | 96.5 | 5.8 | 8.4 |
| AD-66180 | 121.4 | 109.3 | 15.2 | 6.6 |
| AD-66117 | 72.3 | 89.1 | 7.4 | 8.5 |
| AD-66169 | 89.4 | 103.7 | 8.8 | 4.2 |
| AD-66174 | 92 | 103.4 | 18.1 | 8.4 |
| AD-66175 | 89.5 | 112.9 | 13.7 | 8.9 |
| AD-66158 | 103.9 | 105.3 | 11.5 | 15.2 |
| AD-66119 | 66.5 | 92 | 8.9 | 9 |
| AD-66187 | 109.1 | 107 | 16.4 | 10.3 |
| AD-66163 | 89.9 | 106 | 6.8 | 6.1 |
| AD-66116 | 69.8 | 97 | 8.2 | 10.6 |
| AD-66137 | 17.6 | 94.1 | 2.1 | 8.7 |
| AD-66183 | 100.1 | 109.6 | 7.6 | 8.4 |
| AD-66164 | 84 | 98.8 | 10.2 | 9.8 |
| AD-66121 | 2.5 | 30.5 | 0.4 | 3.2 |
| AD-66126 | 4.1 | 22.3 | 0.3 | 2.3 |
| AD-66178 | 79.6 | 112.8 | 6.8 | 16.5 |

TABLE 14

F12 Dose Response Screen in Primary Mouse Hepatocytes

| DuplexId | IC$_{50}$ (nM) |
|---|---|
| AD-66170 | N/A |
| AD-66173 | N/A |
| AD-66176 | 3.571 |
| AD-66125 | 14.962 |
| AD-66172 | 1.104 |
| AD-66167 | 1.013 |
| AD-66165 | 0.231 |
| AD-66168 | N/A |
| AD-66163 | N/A |
| AD-66116 | N/A |
| AD-66121 | 0.119 |
| AD-66126 | 0.045 |

Example 5. KNG1 iRNA Synthesis

Source of Reagents

Where the source of a reagent is not specifically given herein, such reagent can be obtained from any supplier of reagents for molecular biology at a quality/purity standard for application in molecular biology.

Transcripts siRNA Design

A set of siRNAs targeting the human KNG1, "kininogen 1" (human: NCBI refseqID NM_001166451; NCBI GeneID: 3827), as well as toxicology-species KNG1 orthologs (cynomolgus monkey: XM_005545463; mouse: NM_001102409; rat, NM_012696) were designed using custom R and Python scripts. The human NM_001166451 REFSEQ mRNA has a length of 2035 bases. The rationale and method for the set of siRNA designs is as follows: the predicted efficacy for every potential 19mer siRNA from position 235 through position 2035 (the coding region and 3' UTR was determined using a linear model that predicted the direct measure of mRNA knockdown based on the data of more than 20,000 distinct siRNA designs targeting a large number of vertebrate genes. Subsets of the KNG1 siRNAs were designed with perfect or near-perfect matches between human and cynomolgus monkey. A further subset was designed with perfect or near-perfect matches to mouse and rat KNG1 orthologs. For each strand of the siRNA, a custom Python script was used in a brute force search to measure the number and positions of mismatches between the siRNA and all potential alignments in the target species transcriptome. Extra weight was given to mismatches in the seed region, defined here as positions 2-9 of the antisense oligonucleotide, as well the cleavage site of the siRNA, defined here as positions 10-11 of the antisense oligonucleotide. The relative weights for the mismatches were 2.8 for seed mismatches, 1.2 for cleavage site mismatches, and 1 mismatches in other positions up through antisense position 19. Mismatches in the first position were ignored. A specificity score was calculated for each strand by summing the value of each weighted mismatch. Preference was given to siRNAs whose antisense score in human and cynomolgus monkey was >=3.0 and predicted efficacy was >=70% knockdown of the NM_001166451 transcript.

A detailed list of the unmodified KNG1 sense and antisense strand sequences is shown in Table 15. A detailed list of the modified KNG1 sense and antisense strand sequences is shown in Table 16.

siRNA Synthesis

KNG1 siRNA sequences were synthesized at 1 μmol scale on a Mermade 192 synthesizer (BioAutomation) using the solid support mediated phosphoramidite chemistry. The solid support was controlled pore glass (500° A) loaded with custom GalNAc ligand or universal solid support (AM biochemical). Ancillary synthesis reagents, 2'-F and 2'-O-Methyl RNA and deoxy phosphoramidites were obtained from Thermo-Fisher (Milwaukee, WI) and Hongene (China). 2'F 2'-O-Methyl, GNA (glycol nucleic acids), 5'phosphate and other modifications were introduced using the corresponding phosphoramidites. Synthesis of 3' GalNAc conjugated single strands was performed on a GalNAc modified CPG support. Custom CPG universal solid support was used for the synthesis of antisense single strands. Coupling time for all phosphoramidites (100 mM in acetonitrile) was 5 min employing 5-Ethylthio-1H-tetrazole (ETT) as activator (0.6 M in acetonitrile). Phosphorothioate linkages were generated using a 50 mM solution of 3-((Dimethylamino-methylidene) amino)-3H-1,2,4-dithiazole-3-thione (DDTT, obtained from Chemgenes (Wilmington, MA, USA)) in anhydrous acetonitrile/pyridine (1:1 v/v). Oxidation time was 3 minutes. All sequences were synthesized with final removal of the DMT group ("DMT off").

Upon completion of the solid phase synthesis, oligoribonucleotides were cleaved from the solid support and deprotected in sealed 96 deep well plates using 200 μL Aqueous Methylamine reagents at 60° C. for 20 minutes. For sequences containing 2' ribo residues (2'-OH) that are protected with a tert-butyl dimethyl silyl (TBDMS) group, a second step deprotection was performed using TEA·3HF (triethylamine trihydro fluoride) reagent. To the methylamine deprotection solution, 200 uL of dimethyl sulfoxide (DMSO) and 300 ul TEA·3HF reagent was added and the solution was incubated for additional 20 min at 60° C. At the end of cleavage and deprotection step, the synthesis plate was allowed to come to room temperature and was precipitated by addition of 1 mL of acetonitrile:ethanol mixture (9:1). The plates were cooled at −80 C for 2 hrs, superanatant decanted carefully with the aid of a multi channel pipette. The oligonucleotide pellet was re-suspended in 20 mM NaOAc buffer and were desalted using a 5 mL HiTrap size exclusion column (GE Healthcare) on an AKTA Purifier System equipped with an A905 autosampler and a Frac 950 fraction collector. Desalted samples were collected in 96-well plates. Samples from each sequence were analyzed by LC-MS to confirm the identity, UV (260 nm) for quantification and a selected set of samples by IEX chromatography to determine purity.

Annealing of KNG1 single strands was performed on a Tecan liquid handling robot. Equimolar mixture of sense and antisense single strands were combined and annealed in 96 well plates. After combining the complementary single strands, the 96-well plate was sealed tightly and heated in an oven at 100° C. for 10 minutes and allowed to come slowly to room temperature over a period 2-3 hours. The concentration of each duplex was normalized to 10 μM in 1×PBS and then submitted for in vitro screening assays.

TABLE 15

KNG1 Unmodified Sequences

| Duplex name | sense oligo name | Sense Sequence 5' to 3' | SEQ ID NO: | antis oligoname | Antisense Sequence 5' to 3' | SEQ ID NO: | Position in NM_001166451 |
|---|---|---|---|---|---|---|---|
| AD-66259 | A-132506 | GAGGAAAUUGACUGCAAUGAA | 578 | A-132507 | UUCAUUGCAGUCAAUUUCCUCGG | 647 | 301_324 |
| AD-66261 | A-132510 | CACGUUUUAUUCCUUCAAGUA | 579 | A-132511 | UACUUGAAGGAAUAAAACGUGUC | 648 | 438_461 |
| AD-66262 | A-132512 | UACCUACUCAAUUGUGCAAAA | 580 | A-132513 | UUUUGCACAAUUGAGUAGGUAAU | 649 | 822_845 |
| AD-66263 | A-132514 | CUUUCUAUUUCAAGAUUGACA | 581 | A-132515 | UGUCAAUCUUGAAAUAGAAAGUU | 650 | 1118_1141 |
| AD-66260 | A-132508 | AACCCAUGUUCCAAGGAAAA | 582 | A-132509 | UUUUCCUUGGAACAUGUGGUUUC | 651 | 1206_1229 |
| AD-66341 | A-132670 | AAUAAAAGAAGAAACAACUGU | 583 | A-132671 | ACAGUUGUUUCUUCUUUUAUUUC | 652 | 1416_1439 |
| AD-66345 | A-132678 | AGAAGAAACAACUGUAAGUCA | 584 | A-132679 | UGACUUACAGUUGUUUCUUCUUU | 653 | 1422_1445 |
| AD-66328 | A-132644 | CGGGAUUCAGGAAAAGAACAA | 585 | A-132645 | UUGUUCUUUUCCUGAAUCCCGCU | 654 | 1480_1503 |
| AD-66317 | A-132622 | GGGAUUCAGGAAAAGAACAAA | 586 | A-132623 | UUUGUUCUUUUCCUGAAUCCCGC | 655 | 1481_1504 |
| AD-66333 | A-132654 | GGAUUCAGGAAAAGAACAAGA | 587 | A-132655 | UCUUGUUCUUUUCCUGAAUCCCG | 656 | 1482_1505 |
| AD-66338 | A-132664 | GAUUCAGGAAAAGAACAAGGA | 588 | A-132665 | UCCUUGUUCUUUUCCUGAAUCCC | 657 | 1483_1506 |
| AD-66343 | A-132674 | AUUCAGGAAAAGAACAAGGGA | 589 | A-132675 | UCCCUUGUUCUUUUCCUGAAUCC | 658 | 1484_1507 |
| AD-66319 | A-132626 | AAACAUGAACGUGACCAAGGA | 590 | A-132627 | UCCUUGGUCACGUUCAUGUUUAU | 659 | 1567_1590 |
| AD-66346 | A-132680 | CACGAACAACAGCAUGGUCUU | 591 | A-132681 | AAGACCAUGCUGUUGUUCGUGUC | 660 | 1624_1647 |
| AD-66329 | A-132646 | GGUCUUGGUCAUGGACAUAAA | 592 | A-132647 | UUUAUGUCCAUGACCAAGACCAU | 661 | 1639_1662 |
| AD-66270 | A-132528 | CUUGGUCAUGGACAUAAGUUA | 593 | A-132529 | UAACUUAUGUCCAUGACCAAGAC | 662 | 1642_1665 |
| AD-66279 | A-132546 | UUGGUCAUGGACAUAAGUUCA | 594 | A-132547 | UGAACUUAUGUCCAUGACCAAGA | 663 | 1643_1666 |
| AD-66273 | A-132534 | GGUCAUGGACAUAAGUUCAAA | 595 | A-132535 | UUUGAACUUAUGUCCAUGACCAA | 664 | 1645_1668 |
| AD-66264 | A-132516 | AUGGACAUAAGUUCAAACUUA | 596 | A-132517 | UAAGUUUGAACUUAUGUCCAUGA | 665 | 1649_1672 |

TABLE 15-continued

KNG1 Unmodified Sequences

| Duplex name | sense oligo name | Sense Sequence 5' to 3' | SEQ ID NO: | antis oligoname | Antisense Sequence 5' to 3' | SEQ ID NO: | Position in NM_001166451 |
|---|---|---|---|---|---|---|---|
| AD-66342 | A-132672 | GGACAUAAGUUCAAACUUGAU | 597 | A-132673 | AUCAAGUUUGAACUUAUGUCCAU | 666 | 1651_1674 |
| AD-66278 | A-132544 | CAUAAGUUCAAACUUGAUGAU | 598 | A-132545 | AUCAUCAAGUUUGAACUUAUGUC | 667 | 1654_1677 |
| AD-66277 | A-132542 | AUAAGUUCAAACUUGAUGAUA | 599 | A-132543 | UAUCAUCAAGUUUGAACUUAUGU | 668 | 1655_1678 |
| AD-66267 | A-132522 | UUCAAACUUGAUGAUGAUCUU | 600 | A-132523 | AAGAUCAUCAUCAAGUUUGAACU | 669 | 1660_1683 |
| AD-66325 | A-132638 | UCAAACUUGAUGAUGAUCUUA | 601 | A-132639 | UAAGAUCAUCAUCAAGUUUGAAC | 670 | 1661_1684 |
| AD-66320 | A-132628 | AACUUGAUGAUGAUCUUGAAA | 602 | A-132629 | UUUCAAGAUCAUCAUCAAGUUUG | 671 | 1664_1687 |
| AD-66336 | A-132660 | GUCCUUGACCAUGGACAUAAA | 603 | A-132661 | UUUAUGUCCAUGGUCAAGGACAU | 672 | 1699_1722 |
| AD-66280 | A-132548 | GACCAUGGACAUAAGCAUAAA | 604 | A-132549 | UUUAUGCUUAUGUCCAUGGUCAA | 673 | 1705_1728 |
| AD-66272 | A-132532 | AUGGACAUAAGCAUAAGCAUA | 605 | A-132533 | UAUGCUUAUGCUUAUGUCCAUGG | 674 | 1709_1732 |
| AD-66275 | A-132538 | GAAUGGAAAGCACAAUGGUUA | 606 | A-132539 | UAACCAUUGUGCUUUCCAUUCUU | 675 | 1767_1790 |
| AD-66348 | A-132684 | GAAAGCACAAUGGUUGGAAAA | 607 | A-132685 | UUUUCCAACCAUUGUGCUUUCCA | 676 | 1772_1795 |
| AD-66340 | A-132668 | AAGCACAAUGGUUGGAAAACA | 608 | A-132669 | UGUUUUCCAACCAUUGUGCUUUC | 677 | 1774_1797 |
| AD-66330 | A-132648 | AUGGUUGGAAAACAGAGCAUU | 609 | A-132649 | AAUGCUCUGUUUUCCAACCAUUG | 678 | 1781_1804 |
| AD-66306 | A-132600 | GGUUGGAAAACAGAGCAUUUA | 610 | A-132601 | UAAAUGCUCUGUUUUCCAACCAU | 679 | 1783_1806 |
| AD-66322 | A-132632 | AUUUGGCAAGCUCUUCUGAAA | 611 | A-132633 | UUUCAGAAGAGCUUGCCAAAUGC | 680 | 1799_1822 |
| AD-66274 | A-132536 | UCUUCUGAAGACAGUACUACA | 612 | A-132537 | UGUAGUACUGUCUUCAGAAGAGC | 681 | 1810_1833 |
| AD-66271 | A-132530 | CAGAGUGAUGACGAUUGGAUA | 613 | A-132531 | UAUCCAAUCGUCAUCACUCUGUA | 682 | 1975_1998 |
| AD-66339 | A-132666 | CUUUCAUUUAACCCAAUAUCA | 614 | A-132667 | UGAUAUUGGGUUAAAUGAAAGGC | 683 | 2023_2046 |
| AD-66276 | A-132540 | UUUCAUUUAACCCAAUAUCAA | 615 | A-132541 | UUGAUAUUGGGUUAAAUGAAAGG | 684 | 2024_2047 |
| AD-66281 | A-132550 | UUUAACCCAAUAUCAGAUUUU | 616 | A-132551 | AAAAUCUGAUAUUGGGUUAAAUG | 685 | 2029_2052 |
| AD-66313 | A-132614 | UUAACCCAAUAUCAGAUUUUA | 617 | A-132615 | UAAAAUCUGAUAUUGGGUUAAAU | 686 | 2030_2053 |
| AD-66307 | A-132602 | GUGGCUAUGGGUAUUUCUUUA | 618 | A-132603 | UAAAGAAAUACCCAUAGCCACUU | 687 | 2172_2195 |
| AD-66309 | A-132606 | UUUCUUUCAUACUUUAUUAAA | 619 | A-132607 | UUUAAUAAAGUAUGAAAGAAAUA | 688 | 2185_2208 |
| AD-66316 | A-132620 | UUCUUUCAUACUUUAUUAAAA | 620 | A-132621 | UUUUAAUAAAGUAUGAAAGAAAU | 689 | 2186_2209 |
| AD-66321 | A-132630 | UCUUUCAUACUUUAUUAAAGU | 621 | A-132631 | ACUUUAAUAAAGUAUGAAAGAAA | 690 | 2187_2210 |
| AD-66323 | A-132634 | UUCAUACUUUAUUAAAGUAUA | 622 | A-132635 | UAUACUUUAAUAAAGUAUGAAAG | 691 | 2190_2213 |
| AD-66315 | A-132618 | CUUUAUUAAAGUAUCAAUAUA | 623 | A-132619 | UAUAUUGAUACUUUAAUAAAGUA | 692 | 2196_2219 |
| AD-66268 | A-132524 | UUUAUUAAAGUAUCAAUAUCA | 624 | A-132525 | UGAUAUUGAUACUUUAAUAAAGU | 693 | 2197_2220 |
| AD-66332 | A-132652 | AAGUAUCAAUAUCCCUCUCUA | 625 | A-132653 | UAGAGAGGGAUAUUGAUACUUUA | 694 | 2204_2227 |
| AD-66303 | A-132594 | CAUUGUCCAGAUGAAAUAUA | 626 | A-132595 | UAUAUUUCAUCUGGACAAUGGA | 695 | 2225_2248 |
| AD-66334 | A-132656 | AUGAAAAUAUCCUGAUAUAAU | 627 | A-132657 | AUUAUAUCAGGAUAUUUUCAUCU | 696 | 2235_2258 |
| AD-66331 | A-132650 | UCUCCACGGACUGCAUAAAAU | 628 | A-132651 | AUUUUAUGCAGUCCGUGGAGACU | 697 | 2327_2350 |
| AD-66326 | A-132640 | CACGGACUGCAUAAAAUUGUA | 629 | A-132641 | UACAAUUUUAUGCAGUCCGUGGA | 698 | 2331_2354 |
| AD-66312 | A-132612 | CUGCAAUUGGCUUCUCUGAUA | 630 | A-132613 | UAUCAGAGAAGCCAAUUGCAGCA | 699 | 2441_2464 |
| AD-66304 | A-132596 | UGAUAACAAAUAUGUACCUUA | 631 | A-132597 | UAAGGUACAUAUUUGUUAUCAGA | 700 | 2457_2480 |
| AD-66324 | A-132636 | UACCUUACAACAUAUGUCAUA | 632 | A-132637 | UAUGACAUAUGUUGUAAGGUACA | 701 | 2471_2494 |
| AD-66266 | A-132520 | UACAACAUAUGUCAUGAAUUU | 633 | A-132521 | AAAUUCAUGACAUAUGUUGUAAG | 702 | 2476_2499 |

TABLE 15-continued

KNG1 Unmodified Sequences

| Duplex name | sense oligo name | Sense Sequence 5' to 3' | SEQ ID NO: | antis oligoname | Antisense Sequence 5' to 3' | SEQ ID NO: | Position in NM_001166451 |
|---|---|---|---|---|---|---|---|
| AD-66311 | A-132610 | AUUCUUGUCAUUCUUAAUAAA | 634 | A-132611 | UUUAUUAAGAAUGACAAGAAUCU | 703 | 2507_2530 |
| AD-66335 | A-132658 | UUCUUGUCAUUCUUAAUAAAA | 635 | A-132659 | UUUUAUUAAGAAUGACAAGAAUC | 704 | 2508_2531 |
| AD-66344 | A-132676 | UCUUGUCAUUCUUAAUAAACU | 636 | A-132677 | AGUUUAUUAAGAAUGACAAGAAU | 705 | 2509_2532 |
| AD-66305 | A-132598 | AUUUGAAUGUGUGUGAAAAUA | 637 | A-132599 | UAUUUUCACACACAUUCAAAUAC | 706 | 2542_2565 |
| AD-66318 | A-132624 | GAAUGUGUGUGAAAAUAAGGA | 638 | A-132625 | UCCUUAUUUUCACACACAUUCAA | 707 | 2546_2569 |
| AD-66308 | A-132604 | AUGUGUGUGAAAAUAAGGGAA | 639 | A-132605 | UUCCCUUAUUUUCACACACAUUC | 708 | 2548_2571 |
| AD-66327 | A-132642 | GUGUGUGAAAAUAAGGGAAGU | 640 | A-132643 | ACUUCCCUUAUUUUCACACACAU | 709 | 2550_2573 |
| AD-66337 | A-132662 | GUGUGAAAAUAAGGGAAGUCA | 641 | A-132663 | UGACUUCCCUUAUUUUCACACAC | 710 | 2552_2575 |
| AD-66347 | A-132682 | UGUGAAAAUAAGGGAAGUCAA | 642 | A-132683 | UUGACUUCCCUUAUUUUCACACA | 711 | 2553_2576 |
| AD-66269 | A-132526 | GUGAAAAUAAGGGAAGUCAAA | 643 | A-132527 | UUUGACUUCCCUUAUUUUCACAC | 712 | 2554_2577 |
| AD-66314 | A-132616 | AAUAAGGGAAGUCAAGAGAUU | 644 | A-132617 | AAUCUCUUGACUUCCCUUAUUUU | 713 | 2559_2582 |
| AD-66265 | A-132518 | GGGAAGUCAAGAGAUUAAAUA | 645 | A-132519 | UAUUUAAUCUCUUGACUUCCCUU | 714 | 2564_2587 |
| AD-66310 | A-132608 | UAAAUGCUGAACUUAUUAAUA | 646 | A-132609 | UAUUAAUAAGUUCAGCAUUUAAU | 715 | 2579_2602 |

TABLE 16

KNG1 Modified Sequences

| Duplex name | sense oligo name | Sequence 5' to 3' | SEQ ID NO: | antis oligoname | Antisense Sequence 5' to 3' | SEQ ID NO: |
|---|---|---|---|---|---|---|
| AD-66259 | A-132506 | GfsasGfgAfaAfuUfGfAfcUfgCfaAfuGfaAfL96 | 716 | A-132507 | usUfscAfuUfgCfaGfucaAfuUfuCfcUfcsgsg | 785 |
| AD-66261 | A-132510 | CfsasCfgUfuUfuAfUtUfcCfuUfcAfaGfuAfL96 | 717 | A-132511 | usAfscUfgAfAfgGfaauAfaAfaCfgUfgsusc | 786 |
| AD-66262 | A-132512 | UfsasCfcUfaCfuCfAfAfuUfgUfgCfaAfaAfL96 | 718 | A-132513 | usUfsuUfgCfaCfaAfuugAfgUfaGfgUfasasu | 787 |
| AD-66263 | A-132514 | CfsusUfcCfuAfuUtUfCfaAfgAfuUfgAfcAfL96 | 719 | A-132515 | usGfsuCfaAfuCfuUfgaaAfuAfgAfaAfgsusu | 788 |
| AD-66260 | A-132508 | AfsasCfcAfcAfuGfUtUfcCfaAfgGfaAfaAfL96 | 720 | A-132509 | usUfsuUfcCfuUfgGfaacAfuGfuGfgUfususc | 789 |
| AD-66341 | A-132670 | AfsasUfaAfaAfgAfAfGfaAfaCfaAfcUfgUfL96 | 721 | A-132671 | asCfsaGfuUfgUfuUfcuuCfuUfuUfaUfususc | 790 |
| AD-66345 | A-132678 | AfsgsAfaGfaAfaCfAfAfcUfgUfaAfgUfcAfL96 | 722 | A-132679 | usGfsaCfuUfaCfaGfuugUfuUfcUfuCfususu | 791 |
| AD-66328 | A-132644 | CfsgsGfgAfuUfcAfGfGfaAfaAfgAfaCfaAfL96 | 723 | A-132645 | usUfsgUfuCfuUfuUfccuGfaAfUfcCfgscsu | 792 |
| AD-66317 | A-132622 | GfsgsGfaUfuCfaGfGfAfaAfaGfaAfcAfaAfL96 | 724 | A-132623 | usUfsuGfuUfcUfuUfuccUfgAfaUfcCfcsgsc | 793 |
| AD-66333 | A-132654 | GfsgsAfuUfcAfgGfAfAfaAfgAfaCfaAfgAfL96 | 725 | A-132655 | usCfsuUfgUfuCfuUfuuCfuGfaAfUfcCfcscsg | 794 |
| AD-66338 | A-132664 | GfsasUfcAfgGfAfAfaAfGfaAfcAfaGfaAfL96 | 726 | A-132665 | usCfscUfgUfuCfUfcUfuuuCfcUfgAfaUfcscsc | 795 |
| AD-66343 | A-132674 | AfsusUfcAfgGfaAfAfAfgAfaAfcAfaGfaAfL96 | 727 | A-132675 | usCfscCfuUfgUfuCfuuuUfcCfuGfaAfuscsc | 796 |

TABLE 16-continued

| KNG1 Modified Sequences | | | | | | |
|---|---|---|---|---|---|---|
| Duplex name | sense oligo name | Sequence 5' to 3' | SEQ ID NO: | antis oligoname | Antisense Sequence 5' to 3' | SEQ ID NO: |
| AD-66319 | A-132626 | AfsasAfcAfuGfaAfCfGfuGfaCfcAfaGfgAfL96 | 728 | A-132627 | usCfscUfuGfgUfcAfcguUfcAfuGfuUfusasu | 797 |
| AD-66346 | A-132680 | CfsasCfgAfaCfaAfCfAfgCfaUfgGfuCfuUfL96 | 729 | A-132681 | asAfsgAfcCfaUfgCfuguUfgUfuCfgUfgsusc | 798 |
| AD-66329 | A-132646 | GfsgsUfcUfuGfgUfCfAfuGfgAfcAfuAfaAfL96 | 730 | A-132647 | usUfsuAfuGfuCfcAfugaCfcAfaGfaCfcsasu | 799 |
| AD-66270 | A-132528 | CfsusUfgGfuCfaUfGfGfaCfaUfaAfgUfuAfL96 | 731 | A-132529 | usAfsaCfuUfaUfgUfccaUfgAfcCfaAfgsasc | 800 |
| AD-66279 | A-132546 | UfsusGfgUfcAfuGfGfAfcAfuAfaGfuUfcAfL96 | 732 | A-132547 | usGfsaAfcUfuAfuGfuccAfuGfaCfcAfasgsa | 801 |
| AD-66273 | A-132534 | GfsgsUfcAfuGfgAfCfAfuAfaGfuUfcAfaAfL96 | 733 | A-132535 | usUfsuGfaAfcUfuAfuguCfcAfuGfaCfcsasa | 802 |
| AD-66264 | A-132516 | AfsusGfgAfcAfuAfAfGfuUfcAfaAfcUfuAfL96 | 734 | A-132517 | usAfsaGfuUfuGfaAfcuuAfuGfuCfcAfusgsa | 803 |
| AD-66342 | A-132672 | GfsgsAfcAfuAfaGfUtUfcAfaAfcUfuGfaUfL96 | 735 | A-132673 | asUfscAfaGfuUfuGfaacUfuAfuGfuCfcsasu | 804 |
| AD-66278 | A-132544 | CfsasUfaAfgUfuCfAfAfaCfuUfgAfuGfaUfL96 | 736 | A-132545 | asUfscAfuCfaAfgUfuugAfaCfuUfaUfgsusc | 805 |
| AD-66277 | A-132542 | AfsusAfaGfuUfcAfAfAfcUfuGfaUfgAfuAfL96 | 737 | A-132543 | usAfsuCfaUfcAfaGfuuuGfaAfcUfuAfusgsu | 806 |
| AD-66267 | A-132522 | UfsusCfaAfaCfuUfGfaUfgAfuCfuUfL96 | 738 | A-132523 | asAfsgAfuCfaUfcAfucaAfgUfuUfgAfascsu | 807 |
| AD-66325 | A-132638 | UfscsAfaAfcUfuGfAfUfgAfuCfuUfaUfL96 | 739 | A-132639 | usAfsaGfaUfcAfuCfaucAfaGfuUfuGfasasc | 808 |
| AD-66320 | A-132628 | AfsasCfuUfgAfuGfAfUfgAfuCfuUfgAfaAfL96 | 740 | A-132629 | usUfsuCfaAfgAfuCfaucAfuCfaAfgUfususg | 809 |
| AD-66336 | A-132660 | GfsusCfcUfuGfaCfCfAfuGfaAfuAfaAfL96 | 741 | A-132661 | usUfsuAfuGfuCfcAfuggUfcAfaGfaGfcsasu | 810 |
| AD-66280 | A-132548 | GfsasCfcAfuGfgAfCfAfuAfaGfcAfuAfaAfL96 | 742 | A-132549 | usUfsuAfuGfcUfuAfuguCfcAfuGfgUfcsasa | 811 |
| AD-66272 | A-132532 | AfsusGfgAfcAfuAfAfGfcAfuAfgCfaUfaAfL96 | 743 | A-132533 | usAfsuGfcUfuAfuGfcuuAfuGfuCfcAfusgsg | 812 |
| AD-66275 | A-132538 | GfsasAfuGfgAfaAfGfCfaCfaAfuGfgUfuAfL96 | 744 | A-132539 | usAfsaCfaUfuGfuGfcuUfuCfcAfuUfcsusu | 813 |
| AD-66348 | A-132684 | GfsasAfaGfcAfcAfAfUfgGfuUfgGfaAfaAfL96 | 745 | A-132685 | usUfsuUfcCfaAfcCfauuGfuGfcUfuUfcscsa | 814 |
| AD-66340 | A-132668 | AfsasGfcAfcAfaUfGfGfuUfgGfaAfaAfcAfL96 | 746 | A-132669 | usGfsuUfuUfcCfaAfccaUfuGfuGfcUfususc | 815 |
| AD-66330 | A-132648 | AfsusGfgUfgGfaAfAfAfcAfgAfcAfuUfL96 | 747 | A-132649 | asAfsuGfcUfgUfuuuCfcAfaCfcAfususg | 816 |
| AD-66306 | A-132600 | GfsgsUfuGfgAfaAfAfCfaGfaGfcAfuUfuAfL96 | 748 | A-132601 | usAfsaAfuGfcUfcUfguuUfcCfaAfcCfsasu | 817 |
| AD-66322 | A-132632 | AfsusUfgGfgCfaAfGfCfuCffuUfcUfgAfaAfL96 | 749 | A-132633 | usUfsuCfaGfaAfgAfgcuUfgCfcAfaUfusgsc | 818 |
| AD-66274 | A-132536 | UfscsUfuCfuGfaAfGfGfaAfcAfuAfcAfL96 | 750 | A-132537 | usGfsuAfgUfaCfuGfucuUfcAfgAfaGfasgsc | 819 |
| AD-66271 | A-132530 | CfsasGfaGfuGfaUfGfGfaAfcGfaUfuGfcAfL96 | 751 | A-132531 | usAfsuCffcAfaUfcGfucaUfcAfcUfcUfgsusa | 820 |
| AD-66339 | A-132666 | CfsusUfuCfaUfuUfAfAfcCffcAfaUfaUfcAfL96 | 752 | A-132667 | usGfsaUfaUfuGfgGfuuaAfaUfgAfaAfgsgsc | 821 |

TABLE 16-continued

KNG1 Modified Sequences

| Duplex name | sense oligo name | Sequence 5' to 3' | SEQ ID NO: | antis oligoname | Antisense Sequence 5' to 3' | SEQ ID NO: |
|---|---|---|---|---|---|---|
| AD-66276 | A-132540 | UfsusUfcAfuUfuAfAfCfcCfaAfuAfuCfaAfuL96 | 753 | A-132541 | usUfsgAfuAfuUfgGfguuAfaAfuGfaAfasgsg | 822 |
| AD-66281 | A-132550 | UfsusUfaAfcCfcAfAfUfaUfcAfgAfuUfuUfL96 | 754 | A-132551 | asAfsaAfuCfuGfaUfauUfgGfuUfaAfasusg | 823 |
| AD-66313 | A-132614 | UfsusAfaCfcCfaAfUfAfuCfaGfaUfuUfaUfL96 | 755 | A-132615 | usAfsaAfaUfcUfgAfuauUfgGfgUfuAfasasu | 824 |
| AD-66307 | A-132602 | GfsusGfgCfuAfuGfGfGfuAfuUfuCfuUfuAfL96 | 756 | A-132603 | usAfsaAfgAfaAfuAfcccAfuAfgCfcAfcsusu | 825 |
| AD-66309 | A-132606 | UfsusUfcUfuUfcAfUfUfAfcUfuUfaUfaAfuL96 | 757 | A-132607 | usUfsuAfuAfaAfGfuauGfaAfaGfaAfasusa | 826 |
| AD-66316 | A-132620 | UfsusCfuUfuCfaUfAfCfuUfuAfuUfaAfaAfL96 | 758 | A-132621 | usUfsuUfaAfuAfaAfguaUfgAfaAfgAfasasu | 827 |
| AD-66321 | A-132630 | UfscsUfuUfcAfuAfCfUfuUfaUfuAfaAfgUfL96 | 759 | A-132631 | asCfsuUfuAfaUfaAfaguAfuGfaAfaGfasasa | 828 |
| AD-66323 | A-132634 | UfsusCfaUfaCfuUfUfAfuUfaAfaGfuAfuAfL96 | 760 | A-132635 | usAfsuAfcUfuUfaAfuaaAfgUfaUfgAfasasg | 829 |
| AD-66315 | A-132618 | CfsusUfuAfuUfaAfAfgGfuAfuCfaAfuAfAfL96 | 761 | A-132619 | usAfsuAfuUfgAfuAfcuuUfaAfuAfaAfgsusa | 830 |
| AD-66268 | A-132524 | UfsusUfaUfuAfaAfgGfuAfuCfaAfuAfuCfL96 | 762 | A-132525 | usGfsaUfaUfuGfaUfacuUfuAfaUfaAfasgsu | 831 |
| AD-66332 | A-132652 | AfsasGfuAfuCfaAfuAfuCfcCfuCfuCfuAfL96 | 763 | A-132653 | usAfsgAfgAfgGfgAfuauUfgAfuAfcUfususa | 832 |
| AD-66303 | A-132594 | CfsasUfuGfuCfcAfgGfaAfuGfaAfaAfuAfL96 | 764 | A-132595 | usAfsuAfuUfuUfcAfucuGfgAfcAfaUfgsgsa | 833 |
| AD-66334 | A-132656 | AfsusGfaAfaAfuAfuCfcCfuGfaAfuAfaAfL96 | 765 | A-132657 | asUfsuAfuAfuCfaGfgauAfuUfuUfcAfuscsu | 834 |
| AD-66331 | A-132650 | UfscsUfcCfaCfgGfAfCfuGfcAfuAfaUfL96 | 766 | A-132651 | asUfsuUfaUfgCfaUfgucCfgUfgGfaGfascsu | 835 |
| AD-66326 | A-132640 | CfsasCfgGfaCfuGfCfAfuAfaAfuGfuAfL96 | 767 | A-132641 | usAfscAfaUfuUfaUfugcAfgUfcCfgUfgsgsa | 836 |
| AD-66312 | A-132612 | CfsusGfcAfaUfgGfCfuUfcUfgAfuAfuAfL96 | 768 | A-132613 | usAfsuCfaGfaGfaAfgccAfaUfuGfcAfgscsa | 837 |
| AD-66304 | A-132596 | UfsgsAfuAfaCfaAfAfUfaUfgUfaCfcUfuAfL96 | 769 | A-132597 | usAfsaGfgUfaCfaUfauuUfgUfuAfuCfasgsa | 838 |
| AD-66324 | A-132636 | UfsasCfcUfuAfcAfAfcAfuAfuGfcAfuAfL96 | 770 | A-132637 | usAfsuGfaCfaUfaUfguuGfuAfaGfgUfascsa | 839 |
| AD-66266 | A-132520 | UfsasCfaAfcAfuAfUfGfcUfaUfgAfuUfuL96 | 771 | A-132521 | asAfsaUfcAfuAfgUfcauAfuGfuUfgUfasasg | 840 |
| AD-66311 | A-132610 | AfsusUfcUfuGfcCfAfUfcUfuAfuAfaAfL96 | 772 | A-132611 | usUfsuAfuAfaAfgAfaugAfcAfaGfaAfuscsu | 841 |
| AD-66335 | A-132658 | UfsusCfuUfgUfcAfUfUfcUfuAfuAfaAfL96 | 773 | A-132659 | usUfsuAfuAfuAfaGfaauGfaCfaAfgAfasusc | 842 |
| AD-66344 | A-132676 | UfscsUfuGfuCfaUfUfcUfuAfuAfuAfcUfL96 | 774 | A-132677 | asGfsuUfaUfaUfaAfgaaUfgAfcAfaGfasasu | 843 |
| AD-66305 | A-132598 | AfsusUfgGfaAfuGfUfGfuGfuGfaAfuAfuL96 | 775 | A-132599 | usAfsuUfuUfcAfcAfcacAfuUfcAfaAfusasc | 844 |
| AD-66318 | A-132624 | GfsasAfuGfuGfuGfUfGfaAfuAfuAfgAfuL96 | 776 | A-132625 | usCfscUfuAfuUfuUfcacAfcAfcAfuUfcsasa | 845 |

TABLE 16-continued

KNG1 Modified Sequences

| Duplex name | sense oligo name | Sequence 5' to 3' | SEQ ID NO: | antis oligoname | Antisense Sequence 5' to 3' | SEQ ID NO: |
|---|---|---|---|---|---|---|
| AD-66308 | A-132604 | AfsusGfuGfuGfuGfAfAfaAf uAfaGfgGfaAfL96 | 777 | A-132605 | usUfscCfcUfuAfuUfuucAfc AfcAfcAfususc | 846 |
| AD-66327 | A-132642 | GfsusGfuGfuGfaAfAfAfuAf aGfgGfaAfgUfL96 | 778 | A-132643 | asCfsuUfcCfcUfuAfuuuUfc AfcAfcAfcsasu | 847 |
| AD-66337 | A-132662 | GfsusGfuGfaAfaAfUfAfaGf gGfaAfgUfcAfL96 | 779 | A-132663 | usGfsaCfuUfcCfcUfuauUfu UfcAfcAfcsasc | 848 |
| AD-66347 | A-132682 | UfsgsUfgAfaAfaUfAfAfgGf gAfaGfuCfaAfL96 | 780 | A-132683 | usUfsgAfcUfuCfcCfuuaUfu UfuCfaCfascsa | 849 |
| AD-66269 | A-132526 | GfsusGfaAfaAfuAfAfGfgGf aAfgUfcAfaAfL96 | 781 | A-132527 | usUfsuGfaCfuUfcCfcuuAfu UfuUfcAfcsasc | 850 |
| AD-66314 | A-132616 | AfsasUfaAfgGfgAfAfGfuCf aAfgAfgAfuUfL96 | 782 | A-132617 | asAfsuCfuCfuUfgAfcuuCfc CfuUfaUfususu | 851 |
| AD-66265 | A-132518 | GfsgsGfaAfgUfcAfAfGfaGf aUfuAfaAfuAfL96 | 783 | A-132519 | usAfsuUfuAfaUfcUfcuuGfa CfuUfcCfcsusu | 852 |
| AD-66310 | A-132608 | UfsasAfaUfgCfuGfAfAfcU fuAfuUfaAfuAfL96 | 784 | A-132609 | usAfsuUfaAfuAfaGfuucAfg CfaUfuUfasasu | 853 |

Example 6. In Vitro Screening of KNG1 siRNA Duplexes

Cell Culture and Transfections

Hep3b were transfected by adding 4.9 μl of Opti-MEM plus 0.1 μl of Lipofectamine RNAiMax per well (Invitrogen, Carlsbad CA. cat #13778-150) to 5 μl of siRNA duplexes per well into a 384-well plate and incubated at room temperature for 15 minutes. Forty μl of DMEM (Hep3b) of William's E Medium (PMH) containing about $5 \times 10^3$ cells was then added to the siRNA mixture. Cells were incubated for 24 hours prior to RNA purification.

Single dose experiments were performed at 10 nM and 0.01 nM final duplex concentration and dose response experiments were done over a range of doses from 10 nM to 36 fM final duplex concentration over 8, 6-fold dilutions.

Total RNA Isolation Using DYNABEADS mRNA Isolation Kit:

RNA was isolated using an automated protocol on a BioTek-EL406 platform using DYNABEADs (Invitrogen, cat #61012). Briefly, 50 μl of Lysis/Binding Buffer and 25 μl of lysis buffer containing 3 μl of magnetic beads were added to the plate with cells. Plates were incubated on an electromagnetic shaker for 10 minutes at room temperature and then magnetic beads were captured and the supernatant was removed. Bead-bound RNA was then washed 2 times with 150 μl Wash Buffer A and once with Wash Buffer B. Beads were then washed with 150 μl Elution Buffer, re-captured and the supernatant was removed.

cDNA Synthesis Using ABI High Capacity cDNA Reverse Transcription Kit (Applied Biosystems, Foster City, CA, Cat #4368813):

Ten μl of a master mix containing 1 μl 10× Buffer, 0.4 μl 25× dNTPs, 1 μl 10× Random primers, 0.5 μl Reverse Transcriptase, 0.5 μl RNase inhibitor and 6.6 μl of H2O per reaction was added to RNA isolated as described above. Plates were sealed, mixed, and incubated on an electromagnetic shaker for 10 minutes at room temperature, followed by 2 hours 37° C. Plates were then incubated at 81° C. for 8 minutes.

Real Time PCR:

Two μl of cDNA were added to a master mix containing 0.5 μl of GAPDH TaqMan Probe (Hs99999905_m1 or 4352339E), 0.5 μl F12 probe (Hs00166821 or Mm00491349) and 5 μl Lightcycler 480 probe master mix (Roche Cat #04887301001) per well in a 384 well plates (Roche cat #04887301001). Real time PCR was performed using a LightCycler480 Real Time PCR system (Roche) using the ΔΔCt(RQ) assay. Each duplex was tested in four independent transfections.

To calculate relative fold change, real time data were analyzed using the ΔΔCt method and normalized to assays performed with cells transfected with 10 nM AD-1955, or mock transfected cells. $IC_{50}S$ were calculated using a 4 parameter fit model using XLFit and normalized to cells transfected with AD-1955, a non-targeting control, or naïve cells.

The sense and antisense sequences of AD-1955 are:

```
SENSE:
                                        (SEQ ID NO: 2343)
cuuAcGcuGAGuAcuucGAdTsdT;

ANTISENSE:
                                        (SEQ ID NO: 2344)
UCGAAGuACUcAGCGuAAGdTsdT.
```

Table 17 shows the results of a single dose screen in Hep3b cells transfected with the indicated human KNG1 iRNAs. Table 18 shows the results of a dose response screen in Hep3b cells transfected with the indicated human KNG1 iRNAs. Data are expressed as percent of mRNA remaining relative to AD-1955.

TABLE 17

KNG1 Single Dose Screen in Hep3b

| Duplex ID | 10 nM AVG | 0.1 nM AVG | 10 nM ST DEV | 0.1 nM ST DEV |
|---|---|---|---|---|
| AD-66259 | 5 | 30.8 | 1.4 | 12.6 |
| AD-66261 | 14.5 | 74.9 | 4.5 | 37.1 |
| AD-66262 | 14.4 | 40.4 | 12.7 | 19.8 |
| AD-66263 | 23.8 | 87.4 | 33.9 | 20.6 |
| AD-66260 | 42.4 | 78.7 | 12.8 | 20.7 |
| AD-66341 | 30 | 88.9 | 11.8 | 20.6 |
| AD-66345 | 79.5 | 180 | 9.2 | 57.7 |
| AD-66328 | 75.1 | 74.5 | 16.8 | 13.5 |
| AD-66317 | 30.4 | 71.5 | 6.4 | 19.6 |
| AD-66333 | 66 | 90.7 | 23.5 | 31.4 |
| AD-66338 | 74.2 | 123.7 | 30.4 | 35.3 |
| AD-66343 | 69 | 86.9 | 27.3 | 24 |
| AD-66319 | 70.9 | 93.6 | 10.7 | 26.8 |
| AD-66346 | 68.2 | 184.8 | 5.5 | 55.7 |
| AD-66329 | 73.5 | 104.6 | 15.6 | 15.5 |
| AD-66270 | 96.1 | 80.5 | 51.4 | 22.4 |
| AD-66279 | 54.7 | 75.7 | 28.6 | 21.5 |
| AD-66273 | 141.2 | 71.9 | 26.9 | 12.9 |
| AD-66264 | 82.6 | 92.3 | 43.5 | 25.1 |
| AD-66342 | 55.9 | 91.6 | 12.4 | 8.5 |
| AD-66278 | 77.4 | 62.2 | 23.9 | 17.4 |
| AD-66277 | 56.5 | 86 | 41.7 | 31.8 |
| AD-66267 | 56.1 | 68.7 | 22.4 | 15.6 |
| AD-66325 | 40.3 | 60.8 | 13.5 | 19.2 |
| AD-66320 | 70.4 | 99.5 | 16.5 | 6.2 |
| AD-66336 | 102.7 | 94.4 | 26.6 | 21.3 |
| AD-66280 | 71.9 | 94.8 | 32.4 | 19.9 |
| AD-66272 | 150.9 | 241.6 | 43.7 | 195.8 |
| AD-66275 | 49.3 | 100.4 | 12 | 40.6 |
| AD-66348 | 64.8 | 117.2 | 17.2 | 21.5 |
| AD-66340 | 56.7 | 85.1 | 15.7 | 26.4 |
| AD-66330 | 61.5 | 97.1 | 12.4 | 24.9 |
| AD-66306 | 36.1 | 68.4 | 8.2 | 14 |
| AD-66322 | 59.9 | 84.4 | 14.4 | 28.8 |
| AD-66274 | 109.6 | 88.2 | 48 | 17.3 |
| AD-66271 | 130.9 | 70.1 | 25.3 | 20.9 |
| AD-66339 | 68.4 | 107.4 | 29.3 | 27.7 |
| AD-66276 | 40.6 | 85 | 8.8 | 31 |
| AD-66281 | 111.1 | 89.8 | 54.8 | 27.2 |
| AD-66313 | 57.1 | 112.6 | 8.5 | 35.9 |
| AD-66307 | 37.2 | 70.4 | 10 | 5.4 |
| AD-66309 | 42.7 | 58.8 | 9.4 | 11.5 |
| AD-66316 | 42.2 | 75.3 | 10.3 | 9.9 |
| AD-66321 | 63.8 | 106.1 | 28 | 32.4 |
| AD-66323 | 68.7 | 89 | 16.3 | 21.4 |
| AD-66315 | 41.4 | 87.5 | 7.2 | 10.8 |
| AD-66268 | 81.1 | 55 | 34.2 | 5.6 |
| AD-66332 | 59.6 | 74.6 | 22.8 | 22.8 |
| AD-66303 | 63.3 | 52.3 | 9.6 | 7.1 |
| AD-66334 | 47.7 | 72.7 | 11.9 | 36.2 |
| AD-66331 | 51.1 | 98.1 | 13.6 | 33.5 |
| AD-66326 | 53 | 58.9 | 5.7 | 11.7 |
| AD-66312 | 76 | 90.8 | 16.2 | 19.8 |
| AD-66304 | 85.5 | 54.3 | 12.4 | 4.3 |
| AD-66324 | 49.5 | 63.4 | 8.2 | 4.7 |
| AD-66266 | 118.3 | 185.1 | 21.2 | 42.8 |
| AD-66311 | 59 | 68.6 | 4.3 | 15.5 |
| AD-66335 | 65.8 | 74.3 | 9.6 | 28.2 |
| AD-66344 | 113.2 | 110.1 | 41.2 | 37.7 |
| AD-66305 | 62.5 | 100.6 | 18.1 | 32.7 |
| AD-66318 | 56.5 | 60.4 | 12.5 | 5.2 |
| AD-66308 | 43.7 | 65.6 | 12 | 12.9 |
| AD-66327 | 58.5 | 65.8 | 11.9 | 9.2 |
| AD-66337 | 102.8 | 156.4 | 41.6 | 32.7 |
| AD-66347 | 78.4 | 105.7 | 25.9 | 24.3 |
| AD-66269 | 66.2 | 85.1 | 20.4 | 15 |
| AD-66314 | 49.6 | 98.3 | 8.9 | 25.3 |
| AD-66265 | 109.9 | 177.7 | 40.1 | 57.8 |
| AD-66310 | 42.1 | 73.4 | 7 | 27.5 |

TABLE 18

KNG1 Dose Response Screen in Hep3b

| DuplexId | IC$_{50}$ (nM) |
|---|---|
| AD-66259 | 0.035 |
| AD-66261 | 1.02 |
| AD-66262 | 0.04 |
| AD-66263 | 0.299 |

Example 7. In Vivo KLKB1, F12, and KNG1 Silencing in Wild-Type Mice

Figure 7:
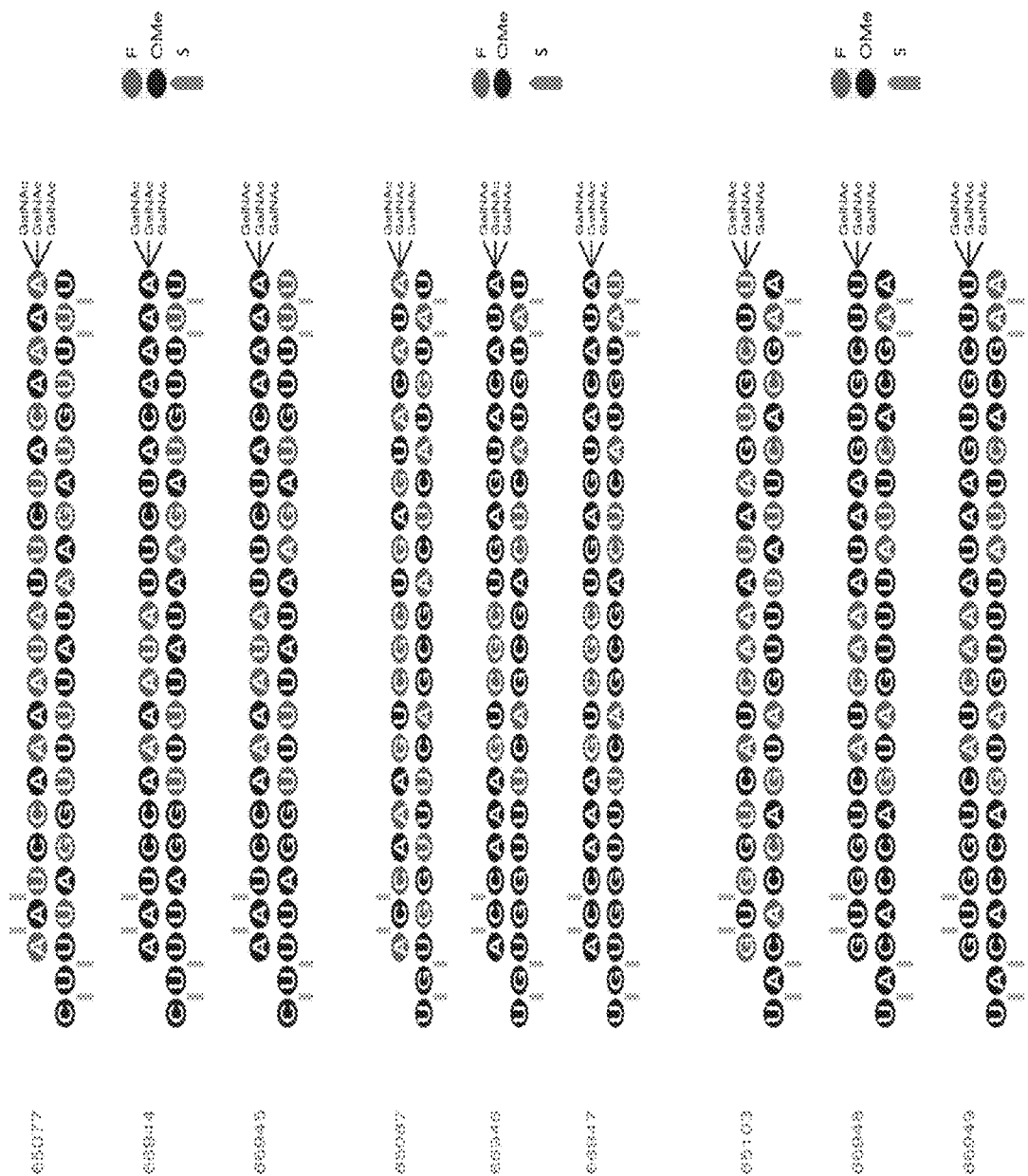
FIG. 7 depicts the modified nucleotide sequences of the indicated double stranded RNAi agents targeting a KLKB1 gene. F is a 2'-fluoro nucleotide modification; OMe is a 2'-O-methyl (2'-OMe) nucleotide modification; and s is a phosphorothioate linkage Figure discloses SEQ ID NOS 2285-2302, respectively, in order of appearance.
Figure 8:
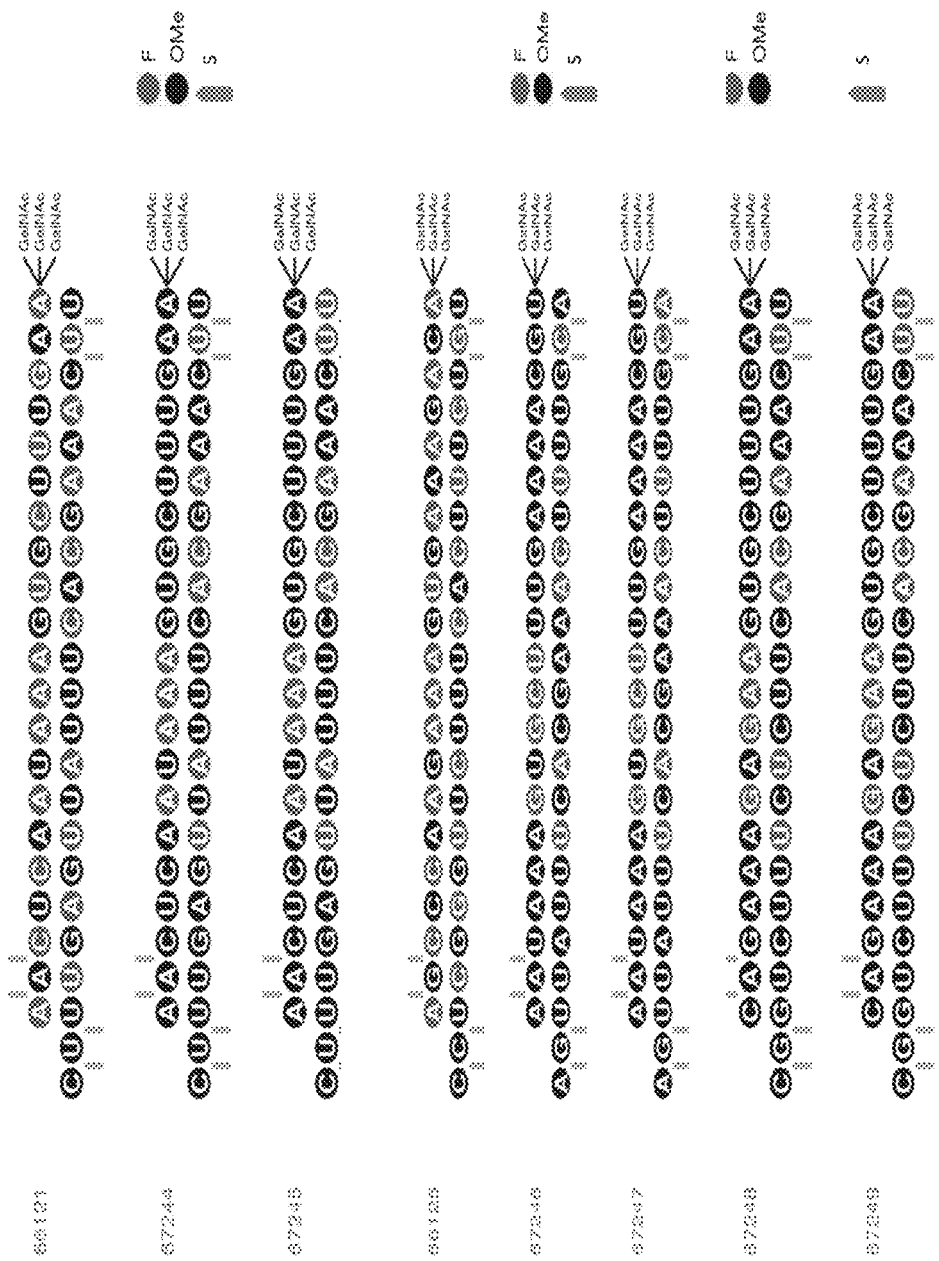
FIG. 8 depicts the modified nucleotide sequences of the indicated double stranded RNAi agents targeting an F12 gene. F is a 2'-fluoro nucleotide modification; OMe is a 2'-O-methyl (2'-OMe) nucleotide modification; and s is a phosphorothioate linkage. Figure discloses SEQ ID NOS 2303-2320, respectively, in order of appearance.
Figure 9:
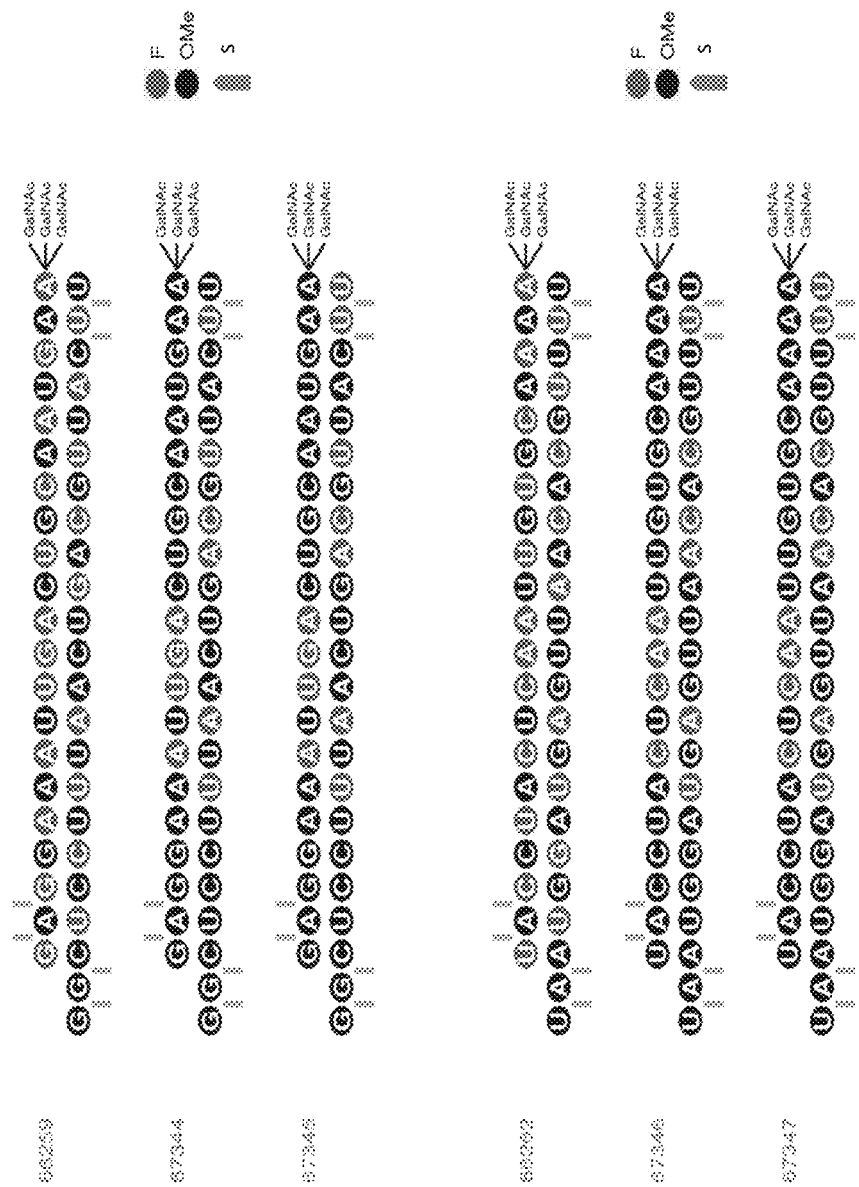
FIG. 9 depicts the modified nucleotide sequences of the indicated double stranded RNAi agents targeting a KNG1 gene. F is a 2'-fluoro nucleotide modification; OMe is a 2'-O-methyl (2'-OMe) nucleotide modification; and s is a phosphorothioate linkage. Figure discloses SEQ ID NOS 2321-2332, respectively, in order of appearance.

Three of the most active agents targeting KLKB1, described above, three of the most active agents targeting F12, described above, and two of the most active agents targeting KNG1, described above, were selected for further evaluation. In particular, additional agents targeting nucleotides 1661-1682, or nucleotides 1905-1926, or nucleotides 382-403 of NM_000892 (a KLKB1 gene) (FIG. 7), additional agents targeting nucleotides 2017-2040, or nucleotides 315-338, or nucleotides 438-459 of NM_000505 (an F12 gene) (FIG. 8), and additional agents targeting nucleotides 301-324 or nucleotides 822-845 of NM_001166451 (a KNG1 gene) (FIG. 9) were synthesized as described above. The in vivo efficacy of these additional agents was assessed by administration of a single subcutaneous dose of the agent to wild-type C57BL/6 mice and determining the level of mRNA at 7-10 days post-dose. The unmodified nucleotide sequences of the sense and antisense strands of the agents depicted in FIG. 7 targeting KLKB1 are provided in Table 19A, and the modified nucleotide sequences of the sense and antisense strands of the agents depicted in FIG. 7 are provided in Table 19B. The unmodified nucleotide sequences of the sense and antisense strands of the agents depicted in FIG. 8 targeting F12 are provided in Table 19C, and the modified nucleotide sequences of the sense and antisense strands of the agents depicted in FIG. 8 are provided in Table 19D. The unmodified nucleotide sequences of the sense and antisense strands of the agents depicted in FIG. 9 targeting KNG1 are provided in Table 19E, and the modified nucleotide sequences of the sense and antisense strands of the agents depicted in FIG. 9 are provided in Table 19F.

In particular, with respect to the additional agents targeting a KLKB1 gene, wild-type C57BL/6 mice were administered a single 1 mg/kg or 3 mg/kg dose of the agent and the level of KLKB1 mRNA was determined at 7-10 days post-dose. The results of these assays are provided in FIG. 1 which demonstrates that AD-66948 was the most efficacious agent targeting a KLKB1 gene that was tested.

Figure 2:
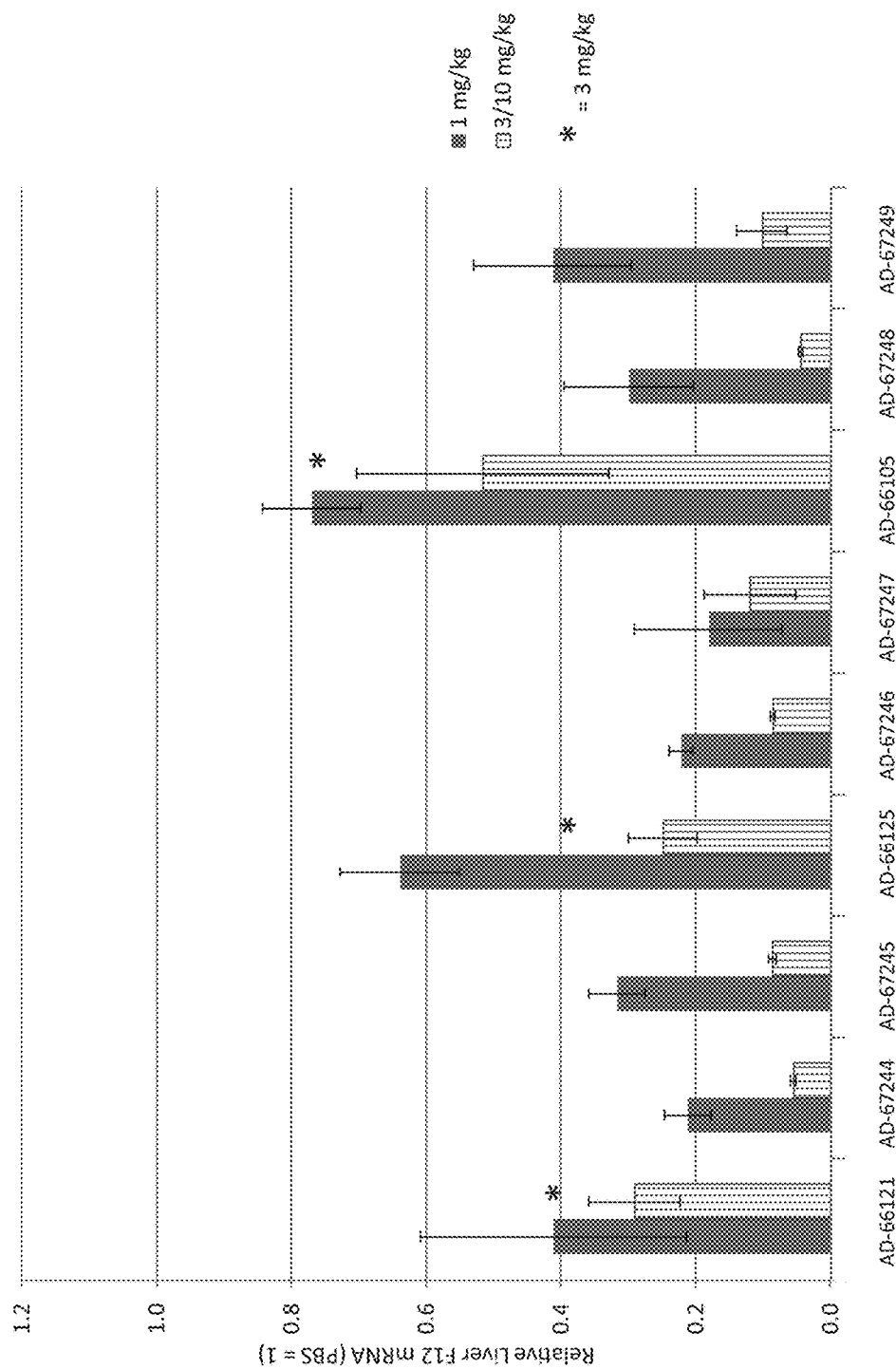
FIG. 2 is a graph depicting F12 mRNA suppression following a single subcutaneous 1 mg/kg dose or a single 3 mg/kg dose, or a single 1 mg/kg dose or a single 10 mg/kg dose of the of the indicated agents at 7-10 days post-dose wild-type mice.

With respect to the additional agents targeting F12, wild-type C57BL/6 mice were administered either a single 1 mg/kg dose or a single 3 mg/kg dose, or a single 1 mg/kg dose or a single 10 mg/kg dose of the agent and the level of F12 mRNA was determined at 7-10 days post-dose. The results of these assays are provided in FIG. 2 which demonstrates that AD-67244 was the most efficacious agent targeting a F12 gene that was tested.

Figure 3:
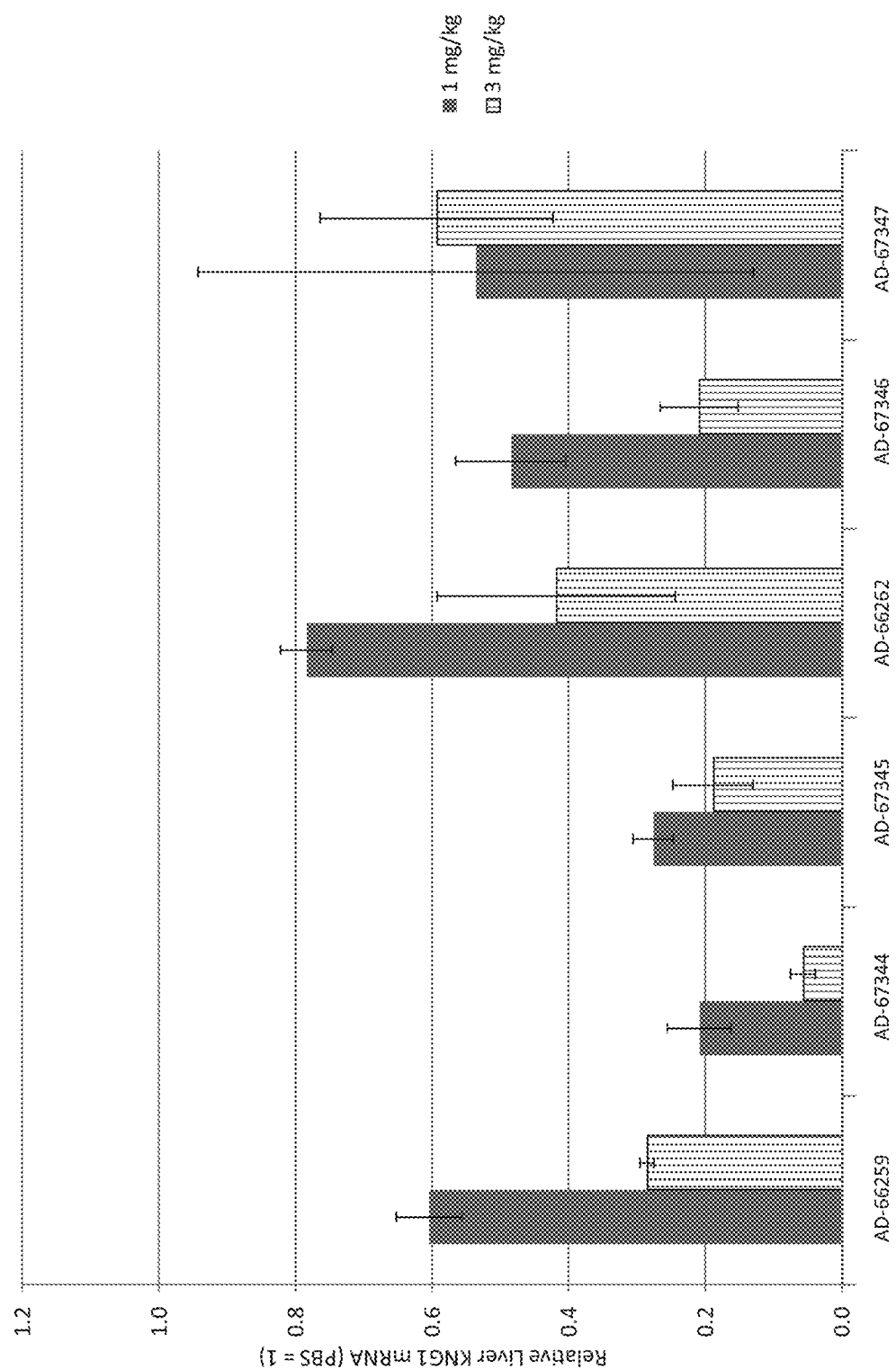
FIG. 3 is a graph depicting KNG1 mRNA suppression following a single subcutaneous 1 mg/kg or 3 mg/kg dose of the indicated agents at 7-10 days post-dose in wild-type mice.
Figure 4A:
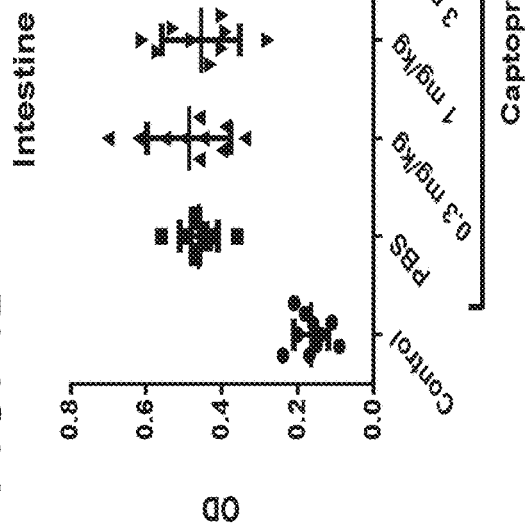
FIG. 4A is a graph depicting the amount of Evans blue dye in the blood of mice administered a single 0 mg/kg, 0.3 mg/kg, 1 mg/kg, 3 mg/kg, or 10 mg/kg dose of AD-66948 and captopril at day 7 post-dose.
Figure 4B:
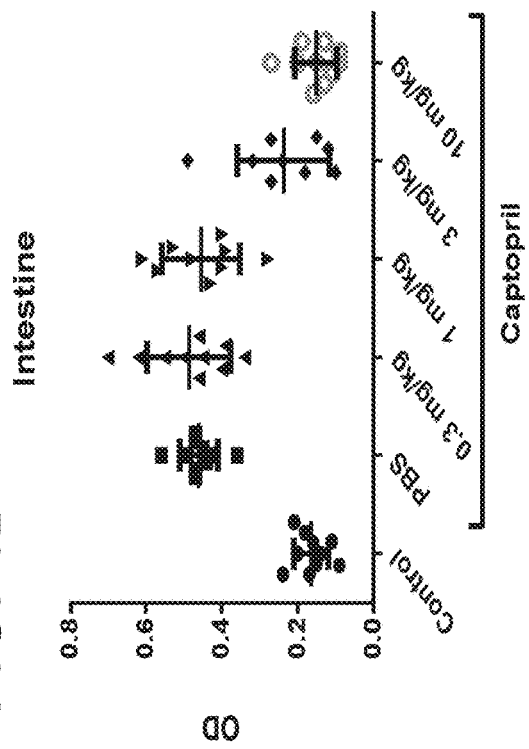
FIG. 4B is a graph depicting the amount of Evans blue dye in the intestines of mice administered a single 0 mg/kg, 0.3 mg/kg, 1 mg/kg, 3 mg/kg, or 10 mg/kg dose of AD-66948 and captopril at day 7 post-dose.
Figure 4C:
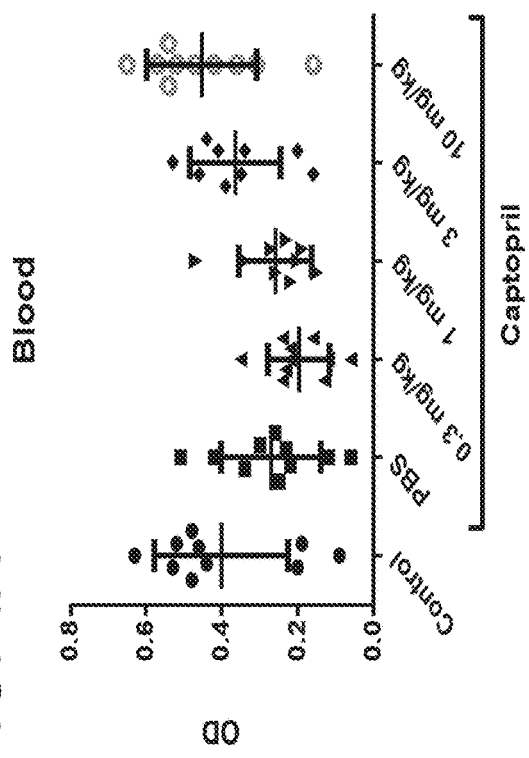
FIG. 4C is a graph depicting KLKB1 mRNA suppression in the liver of mice administered a single 0 mg/kg, 0.3 mg/kg, 1 mg/kg, 3 mg/kg, or 10 mg/kg dose of AD-66948 and captopril at day 7 post-dose.
Figure 4D:
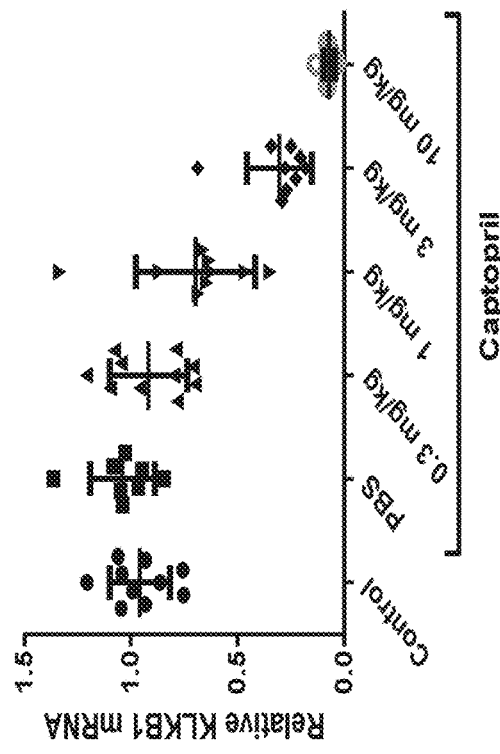
FIG. 4D is a graph depicting the relative permeability of the intestine in mice administered a single 0 mg/kg, 0.3 mg/kg, 1 mg/kg, 3 mg/kg, or 10 mg/kg dose of AD-66948 and captopril at day 7 post-dose.
Figure 5A:
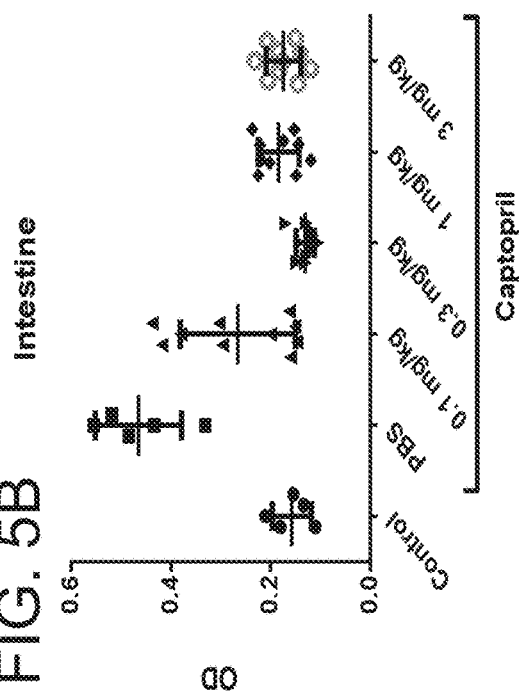
FIG. 5A is a graph depicting the amount of Evans blue dye in the blood of mice administered a single 0 mg/kg, 0.1 mg/kg, 0.3 mg/kg, 1 mg/kg, or 3 mg/kg dose of AD-67244 and captopril at day 7 post-dose.
Figure 5B:
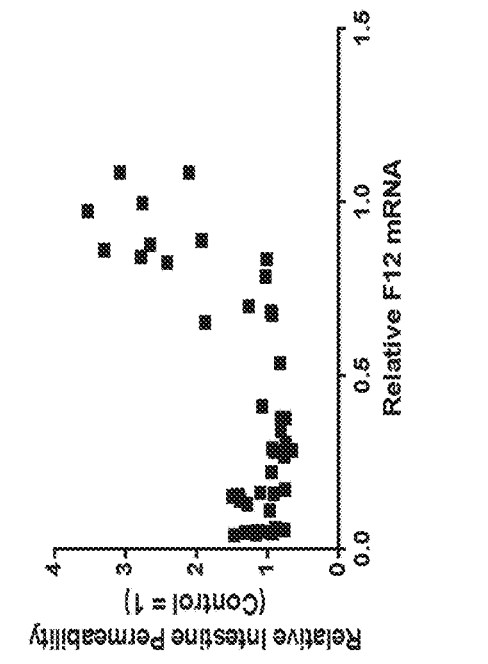
FIG. 5B is a graph depicting the amount of Evans blue dye in the intestines of mice administered a single 0 mg/kg, 0.1 mg/kg, 0.3 mg/kg, 1 mg/kg, or 3 mg/kg dose of AD-67244 and captopril at day 7 post-dose.
Figure 5C:
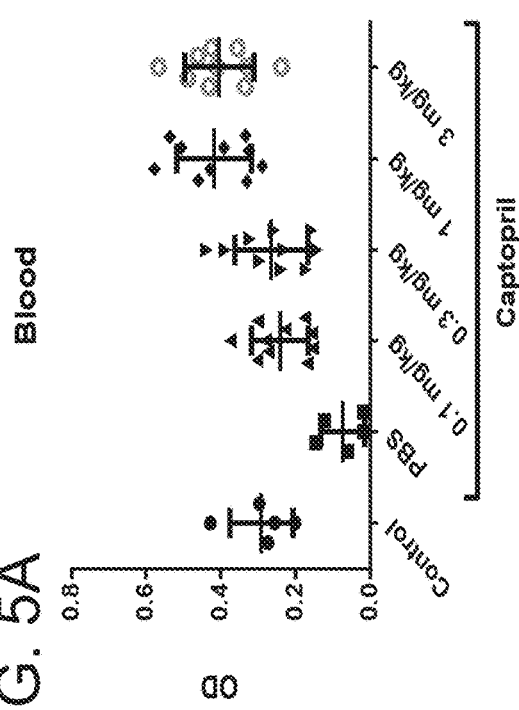
FIG. 5C is a graph depicting F12 mRNA suppression in the liver of mice administered a single 0 mg/kg, 0.1 mg/kg, 0.3 mg/kg, 1 mg/kg, or 3 mg/kg dose of AD-67244 and captopril at day 7 post-dose.
Figure 5D:
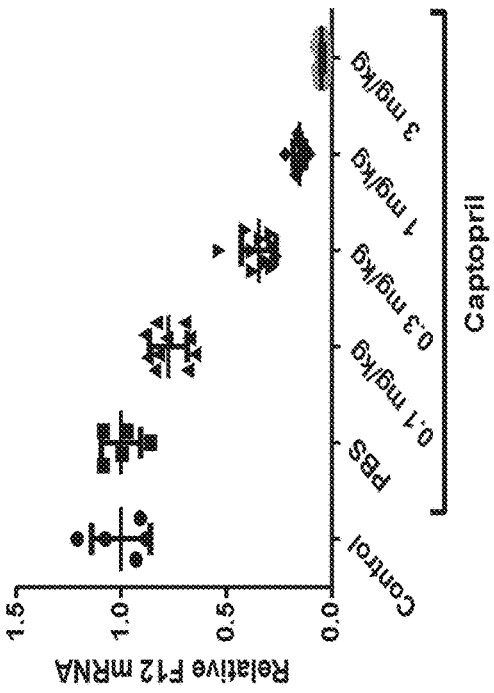
FIG. 5D is a graph depicting the relative permeability of the intestine in mice administered a single 0 mg/kg, 0.1 mg/kg, 0.3 mg/kg, 1 mg/kg, or 3 mg/kg dose of AD-67244 and captopril at day 7 post-dose.

With respect to the additional agents targeting a KNG1 gene, wild-type C57BL/6 mice were administered a single 1 mg/kg or 3 mg/kg dose of the agent and the level of KNG1 mRNA was determined at 7-10 days post-dose. The results of these assays are provided in FIG. 3 which demonstrates that AD-67344 was the most efficacious agent targeting a KNG1 gene that was tested.

TABLE 19A

Unmodified sense and antisense strand sequences of agents targeting KLKB1

| Duplex Name | Target | Antisense Start Position on mRNA | Sense Position in GenBank Reference Sequence | Antisense Position in GenBank Reference Sequence | Sense Sequence | SEQ ID NO | Antisense Sequence | SEQ ID NO |
|---|---|---|---|---|---|---|---|---|
| AD-65077 | KLKB1 | 1659 | NM_000892.3_1661-1681_s | NM_000892.3_1659-1681_as | AAUCCAAAAUAUUC UACAAAA | 854 | UUUUGUAGAAUA UUUGGAUUUC | 863 |
| AD-66944 | KLKB1 | 1659 | NM_000892.3_1661-1681_s | NM_000892.3_1659-1681_as | AAUCCAAAAUAUUC UACAAAA | 855 | UUUUGUAGAAUA UUUGGAUUUC | 864 |
| AD-66945 | KLKB1 | 1659 | NM_000892.3_1661-1681_s | NM_000892.3_1659-1681_as | AAUCCAAAAUAUUC UACAAAA | 856 | UUUUGUAGAAUA UUUGGAUUUC | 865 |
| AD-65087 | KLKB1 | 1903 | NM_000892.3_1905-1925_s | NM_000892.3_1903-1925_as | ACCAAAGUCGCUGA GUACAUA | 857 | UAUGUACUCAGC GACUUUGGUGU | 866 |
| AD-66946 | KLKB1 | 1903 | NM_000892.3_1905-1925_s | NM_000892.3_1903-1925_as | ACCAAAGUCGCUGA GUACAUA | 858 | UAUGUACUCAGC GACUUUGGUGU | 867 |
| AD-66947 | KLKB1 | 1903 | NM_000892.3_1905-1925_s | NM_000892.3_1903-1925_as | ACCAAAGUCGCUGA GUACAUA | 859 | UAUGUACUCAGC GACUUUGGUGU | 868 |
| AD-65103 | KLKB1 | 380 | NM_000892.3_382-402_s | NM_000892.3_380-402_as | GUGGUCAUCAAAUA AGUGCUU | 860 | AAGCACUUAUUU GAUGACCACAU | 869 |
| AD-66948 | KLKB1 | 380 | NM_000892.3_382-402_s | NM_000892.3_380-402_as | GUGGUCAUCAAAUA AGUGCUU | 861 | AAGCACUUAUUU GAUGACCACAU | 870 |
| AD-66949 | KLKB1 | 380 | NM_000892.3_382-402_s | NM_000892.3_380-402_as | GUGGUCAUCAAAUA AGUGCUU | 862 | AAGCACUUAUUU GAUGACCACAU | 871 |

TABLE 19B

Modified sense and antisense strand sequences of agents targeting KLKB1

| Duplex Name | Target | Antisense Start Position on mRNA | Sense Position in GenBank Reference Sequence | Antisense Position in GenBank Reference Sequence | Sense Sequence | SEQ ID NO | Antisense Sequence | SEQ ID NO |
|---|---|---|---|---|---|---|---|---|
| AD-65077 | KLKB1 | 1659 | NM_000892.3_1661-1681_s | NM_000892.3_1659-1681_as | AfsasUfcCfaAfa AfUfAfuUfcUfaC faAfaAfL96 | 872 | usUfsuUfgUfaG faAfuauUfuUfg GfaUfususc | 881 |
| AD-66944 | KLKB1 | 1659 | NM_000892.3_1661-1681_s | NM_000892.3_1659-1681_as | asasuccaAfaAfU fAfuucuacaaaaL96 | 873 | usUfsuugUfaGf AfauauUfuUfgg auususc | 882 |
| AD-66945 | KLKB1 | 1659 | NM_000892.3_1661-1681_s | NM_000892.3_1659-1681_as | asasuccaAfaAfU fAfuucuacaaaaL96 | 874 | UfsUfsuugUfaG fAfauauUfuUfg gauususc | 883 |
| AD-65087 | KLKB1 | 1903 | NM_000892.3_1905-1925_s | NM_000892.3_1903-1925_as | AfscsCfaAfaGfu CfGfCfuGfaGfuA fcAfuAfL96 | 875 | usAfsuGfuAfcU fcAfgcgAfcUfu UfgGfusgsu | 884 |
| AD-66946 | KLKB1 | 1903 | NM_000892.3_1905-1925_s | NM_000892.3_1903-1925_as | ascscaaaGfuCfG fCfugaguacauaL96 | 876 | usAfsuguAfcUf CfagcgAfcUfuu ggusgsu | 885 |
| AD-66947 | KLKB1 | 1903 | NM_000892.3_1905-1925_s | NM_000892.3_1903-1925_as | ascscaaaGfuCfG fCfugaguacauaL96 | 877 | UfsAfsuguAfcU fCfagcgAfcUfu uggusgsu | 886 |
| AD-65013 | KLKB1 | 380 | NM_000892.3_382-402_s | NM_000892.3_380-402_as | GfsusGfgUfcAfu CfAfAfaUfaAfgU fgCfuUfL96 | 878 | asAfsgCfaCfuU faUfuugAfuGfa CfcAfcasu | 887 |
| AD-66948 | KLKB1 | 380 | NM_000892.3_382-402_s | NM_000892.3_380-402_as | gsusgguCfAfuCfA fAfauaagugcuuL96 | 879 | asAfsgcaCfuUf AfuuugAfuGfac cacsasu | 888 |

TABLE 19B-continued

Modified sense and antisense strand sequences of agents targeting KLKB1

| Duplex Name | Target | Antisense Start Position on mRNA | Sense Position in GenBank Reference Sequence | Antisense Position in GenBank Reference Sequence | Sense Sequence | SEQ ID NO | Antisense Sequence | SEQ ID NO |
|---|---|---|---|---|---|---|---|---|
| AD-66949 | KLKB1 | 380 | NM_000892.3_382-402_s | NM_000892.3_380-402_as | gsusggucAfuCfAfAfauaagugcuuL96 | 880 | AfsAfsgcaCfuUfAfuuugAfuGfaccacsasu | 889 |

TABLE 19C

Unmodified sense and antisense strand sequences of agents targeting F12

| Duplex Name | Target | Antisense Start Position on mRNA | Sense Position in GenBank Reference Sequence | Antisense Position in GenBank Reference Sequence | Sense Sequence | SEQ ID NO | Antisense Sequence | SEQ ID NO |
|---|---|---|---|---|---|---|---|---|
| AD-66121 | F12 | 2018 | NM_000505.3_2020-2040_s | NM_000505.3_2018-2040_as | AACUCAAUAAAGUGCUUUGAA | 890 | UUCAAAGCACUUUAUUGAGUUUC | 898 |
| AD-67244 | F12 | 2018 | NM_000505.3_2020-2040_s | NM_000505.3_2018-2040_as | AACUCAAUAAAGUGCUUUGAA | 891 | UUCAAAGCACUUUAUUGAGUUUC | 899 |
| AD-67245 | F12 | 2018 | NM_000505.3_2020-2040_s | NM_000505.3_2018-2040_as | AACUCAAUAAAGUGCUUUGAA | 892 | UUCAAAGCACUUUAUUGAGUUUC | 900 |
| AD-66125 | F12 | 316 | NM_000505.3_318-338_s | NM_000505.3_316-338_as | AGCCCAAGAAAGUGAAAGACA | 893 | UGUCUUUCACUUUCUUGGGCUCC | 901 |
| AD-67246 | F12 | 2023 | NM_000505.3_2025-2045_s | NM_000505.3_2023-2045_as | AAUAAAGUGCUUUGAAAACGU | 894 | ACGUUUUCAAAGCACUUUAUUGA | 902 |
| AD-67247 | F12 | 2023 | NM_000505.3_2025-2045_s | NM_000505.3_2023-2045_as | AAUAAAGUGCUUUGAAAACGU | 895 | ACGUUUUCAAAGCACUUUAUUGA | 903 |
| AD-67248 | F12 | 438 | NM_000028.3_440-460_s | NM_000029.3_438-460_as | CAGAAAGAGAAGUGCUUUGAA | 896 | UUCAAAGCACUUCUCUUUCUGGC | 904 |
| AD-67249 | F12 | 438 | NM_000028.3_440-460_s | NM_000029.3_438-460_as | CAGAAAGAGAAGUGCUUUGAA | 897 | UUCAAAGCACUUCUCUUUCUGGC | 905 |

TABLE 19D

Modified sense and antisense strand sequences of agents targeting F12

| Duplex Name | Target | Antisense Start Position on mRNA | Sense Position in GenBank Reference Sequence | Antisense Position in GenBank Reference Sequence | Sense Sequence | SEQ ID NO | Antisense Sequence | SEQ ID NO |
|---|---|---|---|---|---|---|---|---|
| AD-66121 | F12 | 2018 | NM_000505.3_2020-2040_s | NM_000505.3_2018-2040_as | AfsasCfuCfaAfuAfAfAfgUfgCfuUfuGfaAfL96 | 906 | usUfscAfaAfgCfaCfuuuAfuUfgAfgUfsusc | 914 |
| AD-67244 | F12 | 2018 | NM_000505.3_2020-2040_s | NM_000505.3_2018-2040_as | asascucaAfuAfAfAfgugcuuugaaL96 | 907 | usUfscaaAfgCfAfcuuuAfuUfgaguususc | 915 |
| AD-67245 | F12 | 2018 | NM_000505.3_2020-2040_s | NM_000505.3_2018-2040_as | asascucaAfuAfAfAfgugcuuugaaL96 | 908 | UfsUfscaaAfgCfAfcuuuAfuUfgaguususc | 916 |
| AD-66125 | F12 | 316 | NM_000505.3_318-338_s | NM_000505.3_316-338_as | AfsgsCfcCfaAfgAfAfAfgUfgAfaAfAfgAfcAfL96 | 909 | usGfsuCfuUfuCfAfcuuuCfuUfgGfgCfuscsc | 917 |

TABLE 19D-continued

Modified sense and antisense strand sequences of agents targeting F12

| Duplex Name | Target | Antisense Start Position on mRNA | Sense Position in GenBank Reference Sequence | Antisense Position in GenBank Reference Sequence | Sense Sequence | SEQ ID NO | Antisense Sequence | SEQ ID NO |
|---|---|---|---|---|---|---|---|---|
| AD-67246 | F12 | 2023 | NM_000505.3_2025-2045_s | NM_000505.3_2023-2045_as | asasuaaaGfuGfCfUfuugaaaacguL96 | 910 | asCfsguuUfuCfAfaagcAfcUfuuauusgsa | 918 |
| AD-67247 | F12 | 2023 | NM_000505.3_2025-2045_s | NM_000505.3_2023-2045_as | asasuaaaGfuGfCfUfuugaaaacguL96 | 911 | AfsCfsguuUfuCfAfaagcAfcUfuuauusgsa | 919 |
| AD-67248 | F12 | 438 | NM_000029.3_440-460_s | NM_000029.3_438-460_as | csasgaaaGfaGfAfAfgugcuuugaaL96 | 912 | usUfscaaAfgCfAfcuucUfcUfuucugsgsc | 920 |
| AD-67249 | F12 | 438 | NM_000029.3_440-460_s | NM_000029.3_438-460_as | csasgaaaGfaGfAfAfgugcuuugaaL96 | 913 | UfsUfscaaAfgCfAfcuucUfcUfuucugsgsc | 921 |

TABLE 19E

Unmodified sense and antisense strand sequences of agents targeting KNG1

| Duplex Name | Target | Antisense Start Position on mRNA | Sense Position in GenBank Reference Sequence | Antisense Position in GenBank Reference Sequence | Sense Sequence | SEQ ID NO | Antisense Sequence | SEQ ID NO |
|---|---|---|---|---|---|---|---|---|
| AD-66259 | KNG1 | 302 | NM_000893.3_304-324_s | NM_000893.3_302-324_as | GAGGAAAUUGACUGCAAUGAA | 922 | UUCAUUGCAGUCAAUUUCCUCGG | 928 |
| AD-67344 | KNG1 | 302 | NM_000893.3_304-324_s | NM_000893.3_302-324_as | GAGGAAAUUGACUGCAAUGAA | 923 | UUCAUUGCAGUCAAUUUCCUCGG | 929 |
| AD-67345 | KNG1 | 302 | NM_000893.3_304-324_s | NM_000893.3_302-324_as | GAGGAAAUUGACUGCAAUGAA | 924 | UUCAUUGCAGUCAAUUUCCUCGG | 930 |
| AD-66262 | KNG1 | 823 | NM_000893.3_825-845_s | NM_000893.3_823-845_as | UACCUACUCAAUUGUGCAAAA | 925 | UUUUGCACAAUUGAGUAGGUAAU | 931 |
| AD-67346 | KNG1 | 823 | NM_000893.3_825-845_s | NM_000893.3_823-845_as | UACCUACUCAAUUGUGCAAAA | 926 | UUUUGCACAAUUGAGUAGGUAAU | 932 |
| AD-67347 | KNG1 | 823 | NM_000893.3_825-845_s | NM_000893.3_823-845_as | UACCUACUCAAUUGUGCAAAA | 927 | UUUUGCACAAUUGAGUAGGUAAU | 933 |

TABLE 19F

Modified sense and antisense strand sequences of agents targeting KNG1

| Duplex Name | Target | Antisense Start Position on mRNA | Sense Position in GenBank Reference Sequence | Antisense Position in GenBank Reference Sequence | Sense Sequence | SEQ ID NO | Antisense Sequence | SEQ ID NO |
|---|---|---|---|---|---|---|---|---|
| AD-66259 | KNG1 | 302 | NM_000893.3_304-324_s | NM_000893.3_302-324_as | GfsasGfgAfaAfuUfGfAfcUfgCfaAfuGfaAfL96 | 934 | usUfscAfuUfgCfaGfucaAfuUfuCfcUfcgsg | 940 |
| AD-67344 | KNG1 | 302 | NM_000893.3_304-324_s | NM_000893.3_302-324_as | gsasggaaAfuUfGfAfcugcaaugaaL96 | 935 | usUfscauUfgCfAfgucaAfuUfuccucsgs | 941 |

TABLE 19F-continued

Modified sense and antisense strand sequences of agents targeting KNG1

| Duplex Name | Target | Antisense Start Position on mRNA | Sense Position in GenBank Reference Sequence | Antisense Position in GenBank Reference Sequence | Sense Sequence | SEQ ID NO | Antisense Sequence | SEQ ID NO |
|---|---|---|---|---|---|---|---|---|
| AD-67345 | KNG1 | 302 | NM_000893.3_304-324_s | NM_000893.3_302-324_as | gsasggaaAfuUfG fAfcugcaaugaaL96 | 936 | UfsUfscauUfgCf AfgucaAfuUfucc ucsgsg | 942 |
| AD-66262 | KNG1 | 823 | NM_000893.3_825-845_s | NM_000893.3_823-845_as | UfsasCfcUfaCfu CfAfAfuUfgUfgC faAfaAfL96 | 937 | usUfsuUfgCfaCf aAfuugAfgUfaGf gUfasasu | 943 |
| ad-67346 | KNG1 | 823 | NM_000893.3_825-845_s | NM_000893.3_823-845_as | usasccuaCfuCfA fAfuugugcaaaaL96 | 938 | usUfsuugCfaCfA faaugAfgUfaggu asasu | 944 |
| AD-67347 | KNG1 | 823 | NM_000893.3_825-845_s | NM_000893.3_823-945_as | usasccuaCfuCfA fAfuugugcaaaaL96 | 939 | UfsUfsuugCfaCf AfauugAfgUfagg uasasu | 945 |

Example 8. In Vivo KLKB1, F12, and KNG1 Silencing in ACE-Inhibitor Induced Vascular Permeability Mouse Model To determine the in vivo efficacy of a single dose of a subset of the agents described above to reduce human KLKB1, F12, or KNG1 mRNA levels, wild-type C57BL/6 female mice were subcutaneously administered a single 0 mg/kg, 0.3 mg/kg 1 mg/kg, 3 mg/kg or 10 mg/kg dose of AD-66948 (targeting KLKB1), or a single 0 mg/kg, 0.1 mg/kg 0.3 mg/kg, 1 mg/kg or 3 mg/kg dose of AD-67244 (targeting F12), or a single 0 mg/kg, 0.3 mg/kg 1 mg/kg, 3 mg/kg or 10 mg/kg dose of AD-67344 (targeting KNG1). At day 7 post-dose, animals were intravenously administered 2.5 mg/kg of the angiotensin-converting enzyme (ACE) inhibitor, captopril, in order to induce vascular permeability. Fifteen minutes after administration of captopril, animals were intravenously administered 30 mg/kg Evans blue dye. Fifteen minutes after Evans Blue dye administration, animals were sacrificed and blood, intestine, and liver samples were collected. Evans Blue dye was extracted and quantified from the blood and intestine samples, and target mRNA levels were determined in the liver samples.

The results of these assays using an agent targeting KLKB1 (AD-66948) are shown in FIG. 4. The results of these assays using an agent targeting F12 (AD-AD-67244) are shown in FIG. 5. The results of these assays using an agent targeting KNG1 (AD-AD-67344) are shown in FIG. 6.

Example 9. Synthesis and In Vitro Screening of F12 siRNA Duplexes

Additional iRNA agents targeting F12 were designed, synthesized and screened for in vitro efficacy, as described above. A detailed list of the additional unmodified F12 sense and antisense strand sequences is shown in Table 20. A detailed list of the additional modified F12 sense and antisense strand sequences is shown in Table 21. Table 22 shows the results of a single dose screen in Hep3b cells transfected with the indicated additional F12 iRNAs. Data are expressed as percent of mRNA remaining relative to AD-1955.

TABLE 20

F12 Unmodified Sequences

| Duplex Name | Sense Sequence 5' to 3' | SEQ ID NO | Position in NM_000505.3 | Antisense Sequence 5' to 3' | SEQ ID NO | Position in NM_000505.3 |
|---|---|---|---|---|---|---|
| AD-70653 | GACUCCUGGAUAGGCAGCU | 946 | 12-30 | AGCUGCCUAUCCAGGAGUC | 1130 | 12-30 |
| AD-70654 | UAGGCAGCUGGACCAACGA | 947 | 22-40 | UCGUUGGUCCAGCUGCCUA | 1131 | 22-40 |
| AD-70655 | ACCAACGGACGGAUGCCAU | 948 | 33-51 | AUGGCAUCCGUCCGUUGGU | 1132 | 33-51 |
| AD-70656 | AUGCCAUGAGGGCUCUGCU | 949 | 45-63 | AGCAGAGCCCUCAUGGCAU | 1133 | 45-63 |
| AD-70657 | GCUCUGCUGCUCCUGGGGU | 950 | 56-74 | ACCCCAGGAGCAGCAGAGC | 1134 | 56-74 |
| AD-70658 | UCCUGGGGUUCCUGCUGGU | 951 | 66-84 | ACCAGCAGGAACCCCAGGA | 1135 | 66-84 |
| AD-70659 | CUGCUGGUGAGCUUGGAGU | 952 | 77-95 | ACUCCAAGCUCACCAGCAG | 1136 | 77-95 |
| AD-70660 | CUUGGAGUCAACACUUUCA | 953 | 88-106 | UGAAAGUGUUGACUCCAAG | 1137 | 88-106 |
| AD-70661 | ACUUUCGAUUCCACCUUGA | 954 | 100-118 | UCAAGGUGGAAUCGAAAGU | 1138 | 100-118 |
| AD-70662 | CCACCUUGGGAAGCCCCCA | 955 | 110-128 | UGGGGGCUUCCCAAGGUGG | 1139 | 110-128 |

TABLE 20-continued

F12 Unmodified Sequences

| Duplex Name | Sense Sequence 5' to 3' | SEQ ID NO | Position in NM_000505.3 | Antisense Sequence 5' to 3' | SEQ ID NO | Position in NM_000505.3 |
|---|---|---|---|---|---|---|
| AD-70663 | GCCCCCAAGGAGCAUAAGU | 956 | 122-140 | ACUUAUGCUCCUUGGGGGC | 1140 | 122-140 |
| AD-70664 | CAUAAGUACAAAGCUGAAA | 957 | 134-152 | UUUCAGCUUUGUACUUAUG | 1141 | 134-152 |
| AD-70665 | AAGCUGAAGAGCACACAGU | 958 | 144-162 | ACUGUGUGCUCUUCAGCUU | 1142 | 144-162 |
| AD-70666 | ACACAGUCGUUCUCACUGU | 959 | 156-174 | ACAGUGAGAACGACUGUGU | 1143 | 156-174 |
| AD-70667 | UUCUCACUGUCACCGGGGA | 960 | 165-183 | UCCCCGGUGACAGUGAGAA | 1144 | 165-183 |
| AD-70668 | ACCGGGGAGCCCUGCCACU | 961 | 176-194 | AGUGGCAGGGCUCCCCGGU | 1145 | 176-194 |
| AD-70669 | UGCCACUUCCCCUUCCAGU | 962 | 188-206 | ACUGGAAGGGGAAGUGGCA | 1146 | 188-206 |
| AD-70670 | UUCCAGUACCACCGGCAGA | 963 | 200-218 | UCUGCCGGUGGUACUGGAA | 1147 | 200-218 |
| AD-70671 | ACCGGCAGCUGUACCACAA | 964 | 210-228 | UUGUGGUACAGCUGCCGGU | 1148 | 210-228 |
| AD-70672 | UACCACAAAUGUACCCACA | 965 | 221-239 | UGUGGGUACAUUUGUGGUA | 1149 | 221-239 |
| AD-70673 | UACCCACAAGGGCCGGCCA | 966 | 232-250 | UGGCCGGCCCUUGUGGGUA | 1150 | 232-250 |
| AD-70674 | GCCGGCCAGGCCCUCAGCA | 967 | 243-261 | UGCUGAGGGCCUGGCCGGC | 1151 | 243-261 |
| AD-70675 | CUCAGCCCUGGUGUGCUAA | 968 | 255-273 | UUAGCACACCAGGGCUGAG | 1152 | 255-273 |
| AD-70676 | UGUGCUACCACCCCCAACU | 969 | 266-284 | AGUUGGGGGUGGUAGCACA | 1153 | 266-284 |
| AD-70677 | ACCCCCAACUUUGAUCAGA | 970 | 275-293 | UCUGAUCAAAGUUGGGGGU | 1154 | 275-293 |
| AD-70678 | AUCAGGACCAGCGAUGGGA | 971 | 288-306 | UCCCAUCGCUGGUCCUGAU | 1155 | 288-306 |
| AD-70679 | AGCGAUGGGGAUACUGUUU | 972 | 297-315 | AAACAGUAUCCCCAUCGCU | 1156 | 297-315 |
| AD-70680 | UACUGUUUGGAGCCCAAGA | 973 | 308-326 | UCUUGGGCUCCAAACAGUA | 1157 | 308-326 |
| AD-70681 | CCAAGAAAGUGAAAGACCA | 974 | 321-339 | UGGUCUUUCACUUUCUUGG | 1158 | 321-339 |
| AD-70682 | AAAGACCACUGCAGCAAAC | 975 | 332-350 | GUUUGCUGCAGUGGUCUUU | 1159 | 332-350 |
| AD-70683 | UGCAGCAAACACAGCCCCU | 976 | 341-359 | AGGGGCUGUGUUUGCUGCA | 1160 | 341-359 |
| AD-70684 | AGCCCCUGCCAGAAAGGAA | 977 | 353-371 | UUCCUUUCUGGCAGGGGCU | 1161 | 353-371 |
| AD-70685 | AGAAAGGAGGGACCUGUGU | 978 | 363-381 | ACACAGGUCCCUCCUUUCU | 1162 | 363-381 |
| AD-70686 | ACCUGUGUGAACAUGCCAA | 979 | 374-392 | UUGGCAUGUUCACACAGGU | 1163 | 374-392 |
| AD-70687 | AUGCCAAGCGGCCCCCACU | 980 | 386-404 | AGUGGGGGCCGCUUGGCAU | 1164 | 386-404 |
| AD-70688 | GCCCCCACUGUCUCUGUCA | 981 | 396-414 | UGACAGAGACAGUGGGGGC | 1165 | 396-414 |
| AD-70689 | CACCUCACUGGAAACCACU | 982 | 419-437 | AGUGGUUUCCAGUGAGGUG | 1166 | 419-437 |
| AD-70690 | AACCACUGCCAGAAAGAGA | 983 | 431-449 | UCUCUUUCUGGCAGUGGUU | 1167 | 431-449 |
| AD-70691 | CAGAAAGAGAAGUGCUUUA | 984 | 440-458 | UAAAGCACUUCUCUUUCUG | 1168 | 440-458 |
| AD-70692 | UGCUUUGAGCCUCAGCUUA | 985 | 452-470 | UAAGCUGAGGCUCAAAGCA | 1169 | 452-470 |
| AD-70693 | CAGCUUCUCCGGUUUUUCA | 986 | 464-482 | UGAAAACCGGAGAAGCUG | 1170 | 464-482 |
| AD-70694 | CGGUUUUUCCACAAGAAUA | 987 | 473-491 | UAUUCUUGUGGAAAAACCG | 1171 | 473-491 |
| AD-70695 | CAAGAAUGAGAUAUGGUAU | 988 | 484-502 | AUACCAUAUCUCAUUCUUG | 1172 | 484-502 |
| AD-70696 | UAUGGUAUAGAACUGAGCA | 989 | 495-513 | UGCUCAGUUCUAUACCAUA | 1173 | 495-513 |
| AD-70697 | UGAGCAAGCAGCUGUGGCA | 990 | 508-526 | UGCCACAGCUGCUUGCUCA | 1174 | 508-526 |
| AD-70698 | GCUGUGGCCAGAUGCCAGU | 991 | 518-536 | ACUGGCAUCUGGCCACAGC | 1175 | 518-536 |
| AD-70699 | AUGCCAGUGCAAGGGUCCU | 992 | 529-547 | AGGACCCUUGCACUGGCAU | 1176 | 529-547 |
| AD-70700 | AAGGGUCCUGAUGCCCACU | 993 | 539-557 | AGUGGGCAUCAGGACCCUU | 1177 | 539-557 |

TABLE 20-continued

F12 Unmodified Sequences

| Duplex Name | Sense Sequence 5' to 3' | SEQ ID NO | Position in NM_000505.3 | Antisense Sequence 5' to 3' | SEQ ID NO | Position in NM_000505.3 |
|---|---|---|---|---|---|---|
| AD-70701 | UGCCCACUGCCAGCGGCUA | 994 | 550-568 | UAGCCGCUGGCAGUGGGCA | 1178 | 550-568 |
| AD-70702 | CGGCUGGCCAGCCAGGCCU | 995 | 563-581 | AGGCCUGGCUGGCCAGCCG | 1179 | 563-581 |
| AD-70703 | AGCCAGGCCUGCCGCACCA | 996 | 572-590 | UGGUGCGGCAGGCCUGGCU | 1180 | 572-590 |
| AD-70704 | CGCACCAACCCGUGCCUCA | 997 | 584-602 | UGAGGCACGGGUUGGUGCG | 1181 | 584-602 |
| AD-70705 | UGCCUCCAUGGGGUCGCU | 998 | 596-614 | AGCGACCCCAUGGAGGCA | 1182 | 596-614 |
| AD-70706 | GGGGUCGCUGCCUAGAGGU | 999 | 606-624 | ACCUCUAGGCAGCGACCCC | 1183 | 606-624 |
| AD-70707 | CUAGAGGUGGAGGGCCACA | 1000 | 617-635 | UGUGGCCCUCCACCUCUAG | 1184 | 617-635 |
| AD-70708 | AGGGCCACCGCCUGUGCCA | 1001 | 627-645 | UGGCACAGGCGGUGGCCCU | 1185 | 627-645 |
| AD-70709 | UGUGCCACUGCCCGGUGGA | 1002 | 639-657 | UCCACCGGGCAGUGGCACA | 1186 | 639-657 |
| AD-70710 | CGGUGGGCUACACCGGAGA | 1003 | 651-669 | UCUCCGGUGUAGCCCACCG | 1187 | 651-669 |
| AD-70711 | ACCGGAGCCUUCUGCGACA | 1004 | 662-680 | UGUCGCAGAAGGCUCCGGU | 1188 | 662-680 |
| AD-70712 | UUCUGCGACGUGGACACCA | 1005 | 671-689 | UGGUGUCCACGUCGCAGAA | 1189 | 671-689 |
| AD-70713 | GACACCAAGGCAAGCUGCU | 1006 | 683-701 | AGCAGCUUGCCUUGGUGUC | 1190 | 683-701 |
| AD-70714 | CAAGCUGCUAUGAUGGCCA | 1007 | 693-711 | UGGCCAUCAUAGCAGCUUG | 1191 | 693-711 |
| AD-70715 | GAUGGCCGCGGGCUCAGCU | 1008 | 704-722 | AGCUGAGCCCGCGGCCAUC | 1192 | 704-722 |
| AD-70716 | UCAGCUACCGCGGCCUGGA | 1009 | 717-735 | UCCAGGCCGCGGUAGCUGA | 1193 | 717-735 |
| AD-70717 | CGGCCUGGCCAGGACCACA | 1010 | 727-745 | UGUGGUCCUGGCCAGGCCG | 1194 | 727-745 |
| AD-70718 | AGGACCACGCUCUCGGGUA | 1011 | 737-755 | UACCCGAGAGCGUGGUCCU | 1195 | 737-755 |
| AD-70719 | UCGGGUGCGCCCUGUCAGA | 1012 | 749-767 | UCUGACAGGGCGCACCCGA | 1196 | 749-767 |
| AD-70720 | CUGUCAGCCGUGGGCCUCA | 1013 | 760-778 | UGAGGCCCACGGCUGACAG | 1197 | 760-778 |
| AD-70721 | UGGGCCUCGGAGGCCACCU | 1014 | 770-788 | AGGUGGCCUCCGAGGCCCA | 1198 | 770-788 |
| AD-70722 | CCACCUACCGGAACGUGAA | 1015 | 783-801 | UUCACGUUCCGGUAGGUGG | 1199 | 783-801 |
| AD-70723 | AACGUGACUGCCGAGCAAA | 1016 | 794-812 | UUUGCUCGGCAGUCACGUU | 1200 | 794-812 |
| AD-70724 | CGAGCAAGCGCGGAACUGA | 1017 | 805-823 | UCAGUUCCGCGCUUGCUCG | 1201 | 805-823 |
| AD-70725 | CGGAACUGGGGACUGGGCA | 1018 | 815-833 | UGCCCAGUCCCCAGUUCCG | 1202 | 815-833 |
| AD-70726 | GACUGGGCGGCCACGCCUU | 1019 | 825-843 | AAGGCGUGGCCGCCCAGUC | 1203 | 825-843 |
| AD-70727 | ACGCCUUCUGCCGGAACCA | 1020 | 837-855 | UGGUUCCGGCAGAAGGCGU | 1204 | 837-855 |
| AD-70728 | CGGAACCCGGACAACGACA | 1021 | 848-866 | UGUCGUUGUCCGGGUUCCG | 1205 | 848-866 |
| AD-70729 | AACGACAUCCGCCCGUGGU | 1022 | 860-878 | ACCACGGGCGGAUGUCGUU | 1206 | 860-878 |
| AD-70730 | GCCCGUGGUGCUUCGUGCU | 1023 | 870-888 | AGCACGAAGCACCACGGGC | 1207 | 870-888 |
| AD-70731 | UUCGUGCUGAACCGCGACA | 1024 | 881-899 | UGUCGCGGUUCAGCACGAA | 1208 | 881-899 |
| AD-70732 | ACCGCGACCGGCUGAGCUA | 1025 | 891-909 | UAGCUCAGCCGGUCGCGGU | 1209 | 891-909 |
| AD-70733 | CUGAGCUGGGAGUACUGCA | 1026 | 902-920 | UGCAGUACUCCCAGCUCAG | 1210 | 902-920 |
| AD-70734 | UACUGCGACCUGGCACAGU | 1027 | 914-932 | ACUGUGCCAGGUCGCAGUA | 1211 | 914-932 |
| AD-70735 | UGGCACAGUGCCAGACCCA | 1028 | 924-942 | UGGGUCUGGCACUGUGCCA | 1212 | 924-942 |
| AD-70736 | AGACCCAACCCAGGCGGA | 1029 | 936-954 | UCCGCCUGGGUUGGGUCU | 1213 | 936-954 |
| AD-70737 | AGGCGGCGCCUCCGACCCA | 1030 | 948-966 | UGGGUCGGAGGCGCCGCCU | 1214 | 948-966 |

TABLE 20-continued

F12 Unmodified Sequences

| Duplex Name | Sense Sequence 5' to 3' | SEQ ID NO | Position in NM_000505.3 | Antisense Sequence 5' to 3' | SEQ ID NO | Position in NM_000505.3 |
|---|---|---|---|---|---|---|
| AD-70738 | UCCGACCCCGGUGUCCCCU | 1031 | 958-976 | AGGGGACACCGGGGUCGGA | 1215 | 958-976 |
| AD-70739 | UGUCCCUAGGCUUCAUGU | 1032 | 969-987 | ACAUGAAGCCUAGGGGACA | 1216 | 969-987 |
| AD-70740 | UUCAUGUCCCACUCAUGCA | 1033 | 981-999 | UGCAUGAGUGGGACAUGAA | 1217 | 981-999 |
| AD-70741 | ACUCAUGCCCGCGCAGCCA | 1034 | 991-1009 | UGGCUGCGCGGGCAUGAGU | 1218 | 991-1009 |
| AD-70742 | CGCAGCCGGCACCGCCGAA | 1035 | 1002-1020 | UUCGGCGGUGCCGGCUGCG | 1219 | 1002-1020 |
| AD-70743 | ACCGCCGAAGCCUCAGCCA | 1036 | 1012-1030 | UGGCUGAGGCUUCGGCGGU | 1220 | 1012-1030 |
| AD-70744 | UCAGCCCACGACCCGGACA | 1037 | 1024-1042 | UGUCCGGGUCGUGGGCUGA | 1221 | 1024-1042 |
| AD-70745 | ACCCGGACCCCGCCUCAGU | 1038 | 1034-1052 | ACUGAGGCGGGGUCCGGGU | 1222 | 1034-1052 |
| AD-70562 | CCUCAGUCCCAGACCCCGA | 1039 | 1046-1064 | UCGGGGUCUGGGACUGAGG | 1223 | 1046-1064 |
| AD-70563 | AGACCCCGGGAGCCUUGCA | 1040 | 1056-1074 | UGCAAGGCUCCCGGGGUCU | 1224 | 1056-1074 |
| AD-70564 | CCUUGCCGGCGAAGCGGGA | 1041 | 1068-1086 | UCCCGCUUCGCCGGCAAGG | 1225 | 1068-1086 |
| AD-70565 | AAGCGGGAGCAGCCGCCUU | 1042 | 1079-1097 | AAGGCGGCUGCUCCCGCUU | 1226 | 1079-1097 |
| AD-70566 | AGCCGCCUUCCCUGACCAA | 1043 | 1089-1107 | UUGGUCAGGGAAGGCGGCU | 1227 | 1089-1107 |
| AD-70567 | UGACCAGGAACGGCCCACU | 1044 | 1101-1119 | AGUGGGCCGUUCCUGGUCA | 1228 | 1101-1119 |
| AD-70568 | CGGCCCACUGAGCUGCGGA | 1045 | 1111-1129 | UCCGCAGCUCAGUGGGCCG | 1229 | 1111-1129 |
| AD-70569 | UGCGGGCAGCGGCUCCGCA | 1046 | 1124-1142 | UGCGGAGCCGCUGCCCGCA | 1230 | 1124-1142 |
| AD-70570 | CGGCUCCGCAAGAGUCUGU | 1047 | 1133-1151 | ACAGACUCUUGCGGAGCCG | 1231 | 1133-1151 |
| AD-70571 | AGUCUGUCUUCGAUGACCA | 1048 | 1145-1163 | UGGUCAUCGAAGACAGACU | 1232 | 1145-1163 |
| AD-70572 | CGAUGACCCGCGUCGUUGA | 1049 | 1155-1173 | UCAACGACGCGGGUCAUCG | 1233 | 1155-1173 |
| AD-70573 | UCGUUGGCGGGCUGGUGGA | 1050 | 1167-1185 | UCCACCAGCCCGCCAACGA | 1234 | 1167-1185 |
| AD-70574 | UGGUGGCGCUACGCGGGGA | 1051 | 1179-1197 | UCCCCGCGUAGCGCCACCA | 1235 | 1179-1197 |
| AD-70575 | UACGCGGGGCGCACCCCUA | 1052 | 1188-1206 | UAGGGGUGCGCCCCGCGUA | 1236 | 1188-1206 |
| AD-70576 | ACCCCUACAUCGCCGCGCU | 1053 | 1200-1218 | AGCGCGGCGAUGUAGGGGU | 1237 | 1200-1218 |
| AD-70577 | GCCGCGCUGUACUGGGGCA | 1054 | 1211-1229 | UGCCCCAGUACAGCGCGGC | 1238 | 1211-1229 |
| AD-70578 | CUGGGGCCACAGUUUCUGA | 1055 | 1222-1240 | UCAGAAACUGUGGCCCCAG | 1239 | 1222-1240 |
| AD-70579 | UUUCUGCGCCGGCAGCCUA | 1056 | 1234-1252 | UAGGCUGCCGGCGCAGAAA | 1240 | 1234-1252 |
| AD-70580 | CGGCAGCCUCAUCGCCCCA | 1057 | 1243-1261 | UGGGGCGAUGAGGCUGCCG | 1241 | 1243-1261 |
| AD-70581 | UCGCCCCUGCUGGGUGCU | 1058 | 1254-1272 | AGCACCCAGCAGGGGCGA | 1242 | 1254-1272 |
| AD-70582 | UGGGUGCUGACGGCCGCUA | 1059 | 1265-1283 | UAGCGGCCGUCAGCACCCA | 1243 | 1265-1283 |
| AD-70583 | GCCGCUCACUGCCUGCAGA | 1060 | 1277-1295 | UCUGCAGGCAGUGAGCGGC | 1244 | 1277-1295 |
| AD-70584 | CUGCAGGACCGGCCCGCAA | 1061 | 1289-1307 | UUGCGGGCCGGUCCUGCAG | 1245 | 1289-1307 |
| AD-70585 | GGCCCGCACCCGAGGAUCU | 1062 | 1299-1317 | AGAUCCUCGGGUGCGGGCC | 1246 | 1299-1317 |
| AD-70586 | CGAGGAUCUGACGGUGGUA | 1063 | 1309-1327 | UACCACCGUCAGAUCCUCG | 1247 | 1309-1327 |
| AD-70587 | GUGGUGCUCGGCCAGGAAA | 1064 | 1322-1340 | UUUCCUGGCCGAGCACCAC | 1248 | 1322-1340 |
| AD-70588 | GCCAGGAACGCCGUAACCA | 1065 | 1332-1350 | UGGUUACGGCGUUCCUGGC | 1249 | 1332-1350 |
| AD-70589 | CGUAACCACAGCUGUGAGA | 1066 | 1343-1361 | UCUCACAGCUGUGGUUACG | 1250 | 1343-1361 |
| AD-70590 | UGUGAGCCGUGCCAGACGU | 1067 | 1355-1373 | ACGUCUGGCACGGCUCACA | 1251 | 1355-1373 |
| AD-70591 | UGCCAGACGUUGGCCGUGA | 1068 | 1364-1382 | UCACGGCCAACGUCUGGCA | 1252 | 1364-1382 |

TABLE 20-continued

F12 Unmodified Sequences

| Duplex Name | Sense Sequence 5' to 3' | SEQ ID NO | Position in NM_000505.3 | Antisense Sequence 5' to 3' | SEQ ID NO | Position in NM_000505.3 |
|---|---|---|---|---|---|---|
| AD-70592 | GCCGUGCGCUCCUACCGCU | 1069 | 1376-1394 | AGCGGUAGGAGCGCACGGC | 1253 | 1376-1394 |
| AD-70593 | UACCGCUUGCACGAGGCCU | 1070 | 1388-1406 | AGGCCUCGUGCAAGCGGUA | 1254 | 1388-1406 |
| AD-70594 | ACGAGGCCUUCUCGCCCGU | 1071 | 1398-1416 | ACGGGCGAGAAGGCCUCGU | 1255 | 1398-1416 |
| AD-70595 | UCGCCCGUCAGCUACCAGA | 1072 | 1409-1427 | UCUGGUAGCUGACGGGCGA | 1256 | 1409-1427 |
| AD-70596 | CUACCAGCACGACCUGGCU | 1073 | 1420-1438 | AGCCAGGUCGUGCUGGUAG | 1257 | 1420-1438 |
| AD-70597 | ACCUGGCUCUGUUGCGCCU | 1074 | 1431-1449 | AGGCGCAACAGAGCCAGGU | 1258 | 1431-1449 |
| AD-70598 | UUGCGCCUUCAGGAGGAUA | 1075 | 1442-1460 | UAUCCUCCUGAAGGCGCAA | 1259 | 1442-1460 |
| AD-70599 | GAGGAUGCGGACGGCAGCU | 1076 | 1454-1472 | AGCUGCCGUCCGCAUCCUC | 1260 | 1454-1472 |
| AD-70600 | ACGGCAGCUGCGCGCUCCU | 1077 | 1464-1482 | AGGAGCGCGCAGCUGCCGU | 1261 | 1464-1482 |
| AD-70601 | CGCUCCUGUCGCCUUACGU | 1078 | 1476-1494 | ACGUAAGGCGACAGGAGCG | 1262 | 1476-1494 |
| AD-70602 | CCUUACGUUCAGCCGGUGU | 1079 | 1487-1505 | ACACCGGCUGAACGUAAGG | 1263 | 1487-1505 |
| AD-70603 | AGCCGGUGUGCCUGCCAAA | 1080 | 1497-1515 | UUUGGCAGGCACACCGGCU | 1264 | 1497-1515 |
| AD-70604 | UGCCAAGCGGCGCCGCGCA | 1081 | 1509-1527 | UGCGCGGCGCCGCUUGGCA | 1265 | 1509-1527 |
| AD-70605 | GCGCCGCGCGACCCUCCGA | 1082 | 1518-1536 | UCGGAGGGUCGCGCGGCGC | 1266 | 1518-1536 |
| AD-70606 | CCCUCCGAGACCACGCUCU | 1083 | 1529-1547 | AGAGCGUGGUCUCGGAGGG | 1267 | 1529-1547 |
| AD-70607 | CGCUCUGCCAGGUGGCCGA | 1084 | 1542-1560 | UCGGCCACCUGGCAGAGCG | 1268 | 1542-1560 |
| AD-70608 | AGGUGGCCGGCUGGGGCCA | 1085 | 1551-1569 | UGGCCCCAGCCGGCCACCU | 1269 | 1551-1569 |
| AD-70609 | UGGGGCCACCAGUUCGAGA | 1086 | 1562-1580 | UCUCGAACUGGUGGCCCCA | 1270 | 1562-1580 |
| AD-70610 | UUCGAGGGGCGGAGGAAU | 1087 | 1574-1592 | AUUCCUCCGCCCCUCGAA | 1271 | 1574-1592 |
| AD-70611 | CGGAGGAAUAUGCCAGCUU | 1088 | 1584-1602 | AAGCUGGCAUAUUCCUCCG | 1272 | 1584-1602 |
| AD-70612 | CAGCUUCCUGCAGGAGGCA | 1089 | 1597-1615 | UGCCUCCUGCAGGAAGCUG | 1273 | 1597-1615 |
| AD-70613 | AGGAGGCGCAGGUACCGUU | 1090 | 1608-1626 | AACGGUACCUGCGCCUCCU | 1274 | 1608-1626 |
| AD-70614 | AGGUACCGUUCCUCUCCCU | 1091 | 1617-1635 | AGGGAGAGGAACGGUACCU | 1275 | 1617-1635 |
| AD-70615 | CUCUCCCUGGAGCGCUGCU | 1092 | 1628-1646 | AGCAGCGCUCCAGGGAGAG | 1276 | 1628-1646 |
| AD-70616 | CGCUGCUCAGCCCCGGACA | 1093 | 1640-1658 | UGUCCGGGGCUGAGCAGCG | 1277 | 1640-1658 |
| AD-70617 | CCGGACGUGCACGGAUCCU | 1094 | 1652-1670 | AGGAUCCGUGCACGUCCGG | 1278 | 1652-1670 |
| AD-70618 | CGGAUCCUCCAUCCUCCCA | 1095 | 1663-1681 | UGGGAGGAUGGAGGAUCCG | 1279 | 1663-1681 |
| AD-70619 | CAUCCUCCCCGGCAUGCUA | 1096 | 1672-1690 | UAGCAUGCCGGGGAGGAUG | 1280 | 1672-1690 |
| AD-70620 | CAUGCUCUGCGCAGGGUUA | 1097 | 1684-1702 | UAACCCUGCGCAGAGCAUG | 1281 | 1684-1702 |
| AD-70621 | AGGGUUCCUCGAGGGCGGA | 1098 | 1696-1714 | UCCGCCCUCGAGGAACCCU | 1282 | 1696-1714 |
| AD-70622 | GAGGGCGGCACCGAUGCGU | 1099 | 1706-1724 | ACGCAUCGGUGCCGCCCUC | 1283 | 1706-1724 |
| AD-70623 | GAUGCGUGCCAGGGUGAUU | 1100 | 1718-1736 | AAUCACCCUGGCACGCAUC | 1284 | 1718-1736 |
| AD-70624 | AGGGUGAUUCCGGAGGCCA | 1101 | 1728-1746 | UGGCCUCCGGAAUCACCCU | 1285 | 1728-1746 |
| AD-70625 | CGGAGGCCCGCUGGUGUGU | 1102 | 1738-1756 | ACACACCAGCGGGCCUCCG | 1286 | 1738-1756 |
| AD-70626 | GGUGUGUGAGGACCAAGCU | 1103 | 1750-1768 | AGCUUGGUCCUCACACACC | 1287 | 1750-1768 |
| AD-70627 | CCAAGCUGCAGAGCGCCGA | 1104 | 1762-1780 | UCGGCGCUCUGCAGCUUGG | 1288 | 1762-1780 |
| AD-70628 | AGAGCGCCGGCUCACCCUA | 1105 | 1771-1789 | UAGGGUGAGCCGGCGCUCU | 1289 | 1771-1789 |

TABLE 20-continued

F12 Unmodified Sequences

| Duplex Name | Sense Sequence 5' to 3' | SEQ ID NO | Position in NM_000505.3 | Antisense Sequence 5' to 3' | SEQ ID NO | Position in NM_000505.3 |
|---|---|---|---|---|---|---|
| AD-70629 | UCACCCUGCAAGGCAUCAU | 1106 | 1782-1800 | AUGAUGCCUUGCAGGGUGA | 1290 | 1782-1800 |
| AD-70630 | GGCAUCAUCAGCUGGGGAU | 1107 | 1793-1811 | AUCCCCAGCUGAUGAUGCC | 1291 | 1793-1811 |
| AD-70631 | CUGGGGAUCGGGCUGUGGU | 1108 | 1804-1822 | ACCACAGCCCGAUCCCCAG | 1292 | 1804-1822 |
| AD-70632 | UGUGGUGACCGCAACAAGA | 1109 | 1817-1835 | UCUUGUUGCGGUCACCACA | 1293 | 1817-1835 |
| AD-70633 | CAACAAGCCAGGCGUCUAA | 1110 | 1828-1846 | UUAGACGCCUGGCUUGUUG | 1294 | 1828-1846 |
| AD-70634 | AGGCGUCUACACCGAUGUA | 1111 | 1837-1855 | UACAUCGGUGUAGACGCCU | 1295 | 1837-1855 |
| AD-70635 | GAUGUGGCCUACUACCUGA | 1112 | 1850-1868 | UCAGGUAGUAGGCCACAUC | 1296 | 1850-1868 |
| AD-70636 | UACUACCUGGCCUGGAUCA | 1113 | 1859-1877 | UGAUCCAGGCCAGGUAGUA | 1297 | 1859-1877 |
| AD-70637 | CUGGAUCCGGGAGCACACA | 1114 | 1870-1888 | UGUGUGCUCCCGGAUCCAG | 1298 | 1870-1888 |
| AD-70638 | AGCACACCGUUUCCUGAUU | 1115 | 1881-1899 | AAUCAGGAAACGGUGUGCU | 1299 | 1881-1899 |
| AD-70639 | UCCUGAUUGCUCAGGGACU | 1116 | 1892-1910 | AGUCCCUGAGCAAUCAGGA | 1300 | 1892-1910 |
| AD-70640 | CAGGGACUCAUCUUUCCCU | 1117 | 1903-1921 | AGGGAAAGAUGAGUCCCUG | 1301 | 1903-1921 |
| AD-70641 | UUUCCCUCCUUGGUGAUUA | 1118 | 1915-1933 | UAAUCACCAAGGAGGGAAA | 1302 | 1915-1933 |
| AD-70642 | UGGUGAUUCCGCAGUGAGA | 1119 | 1925-1943 | UCUCACUGCGGAAUCACCA | 1303 | 1925-1943 |
| AD-70643 | AGUGAGAGAGUGGCUGGGA | 1120 | 1937-1955 | UCCCAGCCACUCUCUCACU | 1304 | 1937-1955 |
| AD-70644 | GCUGGGGCAUGGAAGGCAA | 1121 | 1949-1967 | UUGCCUUCCAUGCCCCAGC | 1305 | 1949-1967 |
| AD-70645 | UGGAAGGCAAGAUUGUGUA | 1122 | 1958-1976 | UACACAAUCUUGCCUUCCA | 1306 | 1958-1976 |
| AD-70646 | UUGUGUCCCAUUCCCCAA | 1123 | 1970-1988 | UUGGGGGAAUGGGACACAA | 1307 | 1970-1988 |
| AD-70647 | UCCCCCAGUGCGGCCAGCU | 1124 | 1981-1999 | AGCUGGCCGCACUGGGGGA | 1308 | 1981-1999 |
| AD-70648 | GCCAGCUCCGCGCCAGGAU | 1125 | 1993-2011 | AUCCUGGCGCGGAGCUGGC | 1309 | 1993-2011 |
| AD-70649 | GCCAGGAUGGCGCAGGAAA | 1126 | 2004-2022 | UUUCCUGCGCCAUCCUGGC | 1310 | 2004-2022 |
| AD-70650 | GCAGGAACUCAAUAAAGUA | 1127 | 2015-2033 | UACUUUAUUGAGUUCCUGC | 1311 | 2015-2033 |
| AD-70651 | AAUAAAGUGCUUUGAAAAU | 1128 | 2025-2043 | AUUUUCAAAGCACUUUAUU | 1312 | 2025-2043 |
| AD-70652 | UUGAAAAUGCUGAGAAAAA | 1129 | 2036-2054 | UUUUUCUCAGCAUUUUCAA | 1313 | 2036-2054 |

TABLE 21

F12 Modified Sequences

| Duplex Name | Sense Sequence 5' to 3' | SEQ ID NO | Antisense Sequence 5' to 3' | SEQ ID NO | mRNA target sequence | SEQ ID NO |
|---|---|---|---|---|---|---|
| AD-70653 | GACUCCUGGAUAGGCAGCUdTdT | 1314 | AGCUGCCUAUCCAGGAGUCdTdT | 1498 | GACUCCUGGAUAGGCAGCU | 1682 |
| AD-70654 | UAGGCAGCUGGACCAACGAdTdT | 1315 | UCGUUGGUCCAGCUGCCUAdTdT | 1499 | UAGGCAGCUGGACCAACGG | 1683 |
| AD-70655 | ACCAACGGACGGAUGCCAUdTdT | 1316 | AUGGCAUCCGUCCGUUGGUdTdT | 1500 | ACCAACGGACGGAUGCCAU | 1684 |
| AD-70656 | AUGCCAUGAGGGCUCUGCUdTdT | 1317 | AGCAGAGCCCUCAUGGCAUdTdT | 1501 | AUGCCAUGAGGGCUCUGCU | 1685 |
| AD-70657 | GCUCUGCUGCUCCUGGGGUdTdT | 1318 | ACCCCAGGAGCAGCAGAGCdTdT | 1502 | GCUCUGCUGCUCCUGGGGU | 1686 |
| AD-70658 | UCCUGGGGUUCCUGCUGGUdTdT | 1319 | ACCAGCAGGAACCCCAGGAdTdT | 1503 | UCCUGGGGUUCCUGCUGGU | 1687 |
| AD-70659 | CUGCUGGUGAGCUUGGAGUdTdT | 1320 | ACUCCAAGCUCACCAGCAGdTdT | 1504 | CUGCUGGUGAGCUUGGAGU | 1688 |
| AD-70660 | CUUGGAGUCAACACUUUCAdTdT | 1321 | UGAAAGUGUUGACUCCAAGdTdT | 1505 | CUUGGAGUCAACACUUUCG | 1689 |
| AD-70661 | ACUUUCGAUUCCACCUUGAdTdT | 1322 | UCAAGGUGGAAUCGAAAGUdTdT | 1506 | ACUUUCGAUUCCACCUUGG | 1690 |

TABLE 21-continued

F12 Modified Sequences

| Duplex Name | Sense Sequence 5' to 3' | SEQ ID NO | Antisense Sequence 5' to 3' | SEQ ID NO | mRNA target sequence | SEQ ID NO |
|---|---|---|---|---|---|---|
| AD-70662 | CCACCUUGGGAAGCCCCCAdTdT | 1323 | UGGGGGCUUCCCAAGGUGGdTdT | 1507 | CCACCUUGGGAAGCCCCA | 1691 |
| AD-70663 | GCCCCCAAGGAGCAUAAGUdTdT | 1324 | ACUUAUGCUCCUUGGGGGCdTdT | 1508 | GCCCCCAAGGAGCAUAAGU | 1692 |
| AD-70664 | CAUAAGUACAAAGCUGAAAdTdT | 1325 | UUUCAGCUUUGUACUUAUGdTdT | 1509 | CAUAAGUACAAAGCUGAAG | 1693 |
| AD-70665 | AAGCUGAAGAGCACACAGUdTdT | 1326 | ACUGUGUGCUCUUCAGCUUdTdT | 1510 | AAGCUGAAGAGCACACAGU | 1694 |
| AD-70666 | ACACAGUCGUUCUCACUGUdTdT | 1327 | ACAGUGAGAACGACUGUGUdTdT | 1511 | ACACAGUCGUUCUCACUGU | 1695 |
| AD-70667 | UUCUCACUGUCACCGGGGAdTdT | 1328 | UCCCCGGUGACAGUGAGAAdTdT | 1512 | UUCUCACUGUCACCGGGGA | 1696 |
| AD-70668 | ACCGGGGAGCCCUGCCACUdTdT | 1329 | AGUGGCAGGGCUCCCCGGUdTdT | 1513 | ACCGGGGAGCCCUGCCACU | 1697 |
| AD-70669 | UGCCACUUCCCCUUCCAGUdTdT | 1330 | ACUGGAAGGGGAAGUGGCAdTdT | 1514 | UGCCACUUCCCCUUCCAGU | 1698 |
| AD-70670 | UUCCAGUACCACCGGCAGAdTdT | 1331 | UCUGCCGGUGGUACUGGAAdTdT | 1515 | UUCCAGUACCACCGGCAGC | 1699 |
| AD-70671 | ACCGGCAGCUGUACCACAAdTdT | 1332 | UUGUGGUACAGCUGCCGGUdTdT | 1516 | ACCGGCAGCUGUACCACAA | 1700 |
| AD-70672 | UACCACAAAUGUACCCACAdTdT | 1333 | UGUGGGUACAUUUGUGGUAdTdT | 1517 | UACCACAAAUGUACCCACA | 1701 |
| AD-70673 | UACCCACAAGGGCCGGCCAdTdT | 1334 | UGGCCGGCCCUUGUGGGUAdTdT | 1518 | UACCCACAAGGGCCGGCCA | 1702 |
| AD-70674 | GCCGGCCAGGCCCUCAGCAdTdT | 1335 | UGCUGAGGGCCUGGCCGGCdTdT | 1519 | GCCGGCCAGGCCCUCAGCC | 1703 |
| AD-70675 | CUCAGCCCUGGUGUGCUAAdTdT | 1336 | UUAGCACACCAGGGCUGAGdTdT | 1520 | CUCAGCCCUGGUGUGCUAC | 1704 |
| AD-70676 | UGUGCUACCACCCCCAACUdTdT | 1337 | AGUUGGGGGUGGUAGCACAdTdT | 1521 | UGUGCUACCACCCCCAACU | 1705 |
| AD-70677 | ACCCCCAACUUUGAUCAGAdTdT | 1338 | UCUGAUCAAAGUUGGGGGUdTdT | 1522 | ACCCCCAACUUUGAUCAGG | 1706 |
| AD-70678 | AUCAGGACCAGCGAUGGGAdTdT | 1339 | UCCCAUCGCUGGUCCUGAUdTdT | 1523 | AUCAGGACCAGCGAUGGGG | 1707 |
| AD-70679 | AGCGAUGGGGAUACUGUUUdTdT | 1340 | AAACAGUAUCCCCAUCGCUdTdT | 1524 | AGCGAUGGGGAUACUGUUU | 1708 |
| AD-70680 | UACUGUUUGGAGCCCAAGAdTdT | 1341 | UCUUGGGCUCCAAACAGUAdTdT | 1525 | UACUGUUUGGAGCCCAAGA | 1709 |
| AD-70681 | CCAAGAAAGUGAAAGACCAdTdT | 1342 | UGGUCUUUCACUUUCUUGGdTdT | 1526 | CCAAGAAAGUGAAAGACCA | 1710 |
| AD-70682 | AAAGACCACUGCAGCAAACdTdT | 1343 | GUUUGCUGCAGUGGUCUUUdTdT | 1527 | AAAGACCACUGCAGCAAAC | 1711 |
| AD-70683 | UGCAGCAAACACAGCCCCUdTdT | 1344 | AGGGGCUGUGUUUGCUGCAdTdT | 1528 | UGCAGCAAACACAGCCCCU | 1712 |
| AD-70684 | AGCCCCUGCCAGAAAGGAAdTdT | 1345 | UUCCUUUCUGGCAGGGGCUdTdT | 1529 | AGCCCCUGCCAGAAAGGAG | 1713 |
| AD-70685 | AGAAAGGAGGGACCUGUGUdTdT | 1346 | ACACAGGUCCCUCCUUUCUdTdT | 1530 | AGAAAGGAGGGACCUGUGU | 1714 |
| AD-70686 | ACCUGUGUGAACAUGCCAAdTdT | 1347 | UUGGCAUGUUCACACAGGUdTdT | 1531 | ACCUGUGUGAACAUGCCAA | 1715 |
| AD-70687 | AUGCCAAGCGGCCCCCACUdTdT | 1348 | AGUGGGGGCCGCUUGGCAUdTdT | 1532 | AUGCCAAGCGGCCCCCACU | 1716 |
| AD-70688 | GCCCCCACUGUCUCUGUCAdTdT | 1349 | UGACAGAGACAGUGGGGGCdTdT | 1533 | GCCCCCACUGUCUCUGUCC | 1717 |
| AD-70689 | CACCUCACUGGAAACCACUdTdT | 1350 | AGUGGUUUCCAGUGAGGUGdTdT | 1534 | CACCUCACUGGAAACCACU | 1718 |
| AD-70690 | AACCACUGCCAGAAAGAGAdTdT | 1351 | UCUCUUUCUGGCAGUGGUUdTdT | 1535 | AACCACUGCCAGAAAGAGA | 1719 |
| AD-70691 | CAGAAAGAGAAGUGCUUUAdTdT | 1352 | UAAAGCACUUCUCUUUCUGdTdT | 1536 | CAGAAAGAGAAGUGCUUUG | 1720 |
| AD-70692 | UGCUUUGAGCCUCAGCUUAdTdT | 1353 | UAAGCUGAGGCUCAAAGCAdTdT | 1537 | UGCUUUGAGCCUCAGCUUC | 1721 |
| AD-70693 | CAGCUUCUCCGGUUUUUCAdTdT | 1354 | UGAAAACCGGAGAAGCUGdTdT | 1538 | CAGCUUCUCCGGUUUUUCC | 1722 |
| AD-70694 | CGGUUUUUCCACAAGAAUAdTdT | 1355 | UAUUCUUGUGGAAAAACCGdTdT | 1539 | CGGUUUUUCCACAAGAAUG | 1723 |
| AD-70695 | CAAGAAUGAGAUAUGGUAUdTdT | 1356 | AUACCAUAUCUCAUUCUUGdTdT | 1540 | CAAGAAUGAGAUAUGGUAU | 1724 |
| AD-70696 | UAUGGUAUAGAACUGAGCAdTdT | 1357 | UGCUCAGUUCUAUACCAUAdTdT | 1541 | UAUGGUAUAGAACUGAGCA | 1725 |
| AD-70697 | UGAGCAAGCAGCUGUGGCAdTdT | 1358 | UGCCACAGCUGCUUGCUCAdTdT | 1542 | UGAGCAAGCAGCUGUGGCC | 1726 |
| AD-70698 | GCUGUGGCCAGAUGCCAGUdTdT | 1359 | ACUGGCAUCUGGCCACAGCdTdT | 1543 | GCUGUGGCCAGAUGCCAGU | 1727 |

TABLE 21-continued

F12 Modified Sequences

| Duplex Name | Sense Sequence 5' to 3' | SEQ ID NO | Antisense Sequence 5' to 3' | SEQ ID NO | mRNA target sequence | SEQ ID NO |
|---|---|---|---|---|---|---|
| AD-70699 | AUGCCAGUGCAAGGGUCCUdTdT | 1360 | AGGACCCUUGCACUGGCAUdTdT | 1544 | AUGCCAGUGCAAGGGUCCU | 1728 |
| AD-70700 | AAGGGUCCUGAUGCCCACUdTdT | 1361 | AGUGGGCAUCAGGACCCUUdTdT | 1545 | AAGGGUCCUGAUGCCCACU | 1729 |
| AD-70701 | UGCCCACUGCCAGCGGCUAdTdT | 1362 | UAGCCGCUGGCAGUGGGCAdTdT | 1546 | UGCCCACUGCCAGCGGCUG | 1730 |
| AD-70702 | CGGCUGGCCAGCCAGGCCUdTdT | 1363 | AGGCCUGGCUGGCCAGCCGdTdT | 1547 | CGGCUGGCCAGCCAGGCCU | 1731 |
| AD-70703 | AGCCAGGCCUGCCGCACCAdTdT | 1364 | UGGUGCGGCAGGCCUGGCUdTdT | 1548 | AGCCAGGCCUGCCGCACCA | 1732 |
| AD-70704 | CGCACCAACCCGUGCCUCAdTdT | 1365 | UGAGGCACGGGUUGGUGCGdTdT | 1549 | CGCACCAACCCGUGCCUCC | 1733 |
| AD-70705 | UGCCUCCAUGGGGUCGCUdTdT | 1366 | AGCGACCCCAUGGAGGCAdTdT | 1550 | UGCCUCCAUGGGGUCGCU | 1734 |
| AD-70706 | GGGGUCGCUGCCUAGAGGUdTdT | 1367 | ACCUCUAGGCAGCGACCCCdTdT | 1551 | GGGGUCGCUGCCUAGAGGU | 1735 |
| AD-70707 | CUAGAGGUGGAGGGCCACAdTdT | 1368 | UGUGGCCCUCCACCUCUAGdTdT | 1552 | CUAGAGGUGGAGGGCCACC | 1736 |
| AD-70708 | AGGGCCACCGCCUGUGCCAdTdT | 1369 | UGGCACAGGCGGUGGCCCUdTdT | 1553 | AGGGCCACCGCCUGUGCCA | 1737 |
| AD-70709 | UGUGCCACUGCCCGGUGGAdTdT | 1370 | UCCACCGGGCAGUGGCACAdTdT | 1554 | UGUGCCACUGCCCGGUGGG | 1738 |
| AD-70710 | CGGUGGGCUACACCGGAGAdTdT | 1371 | UCUCCGGUGUAGCCCACCGdTdT | 1555 | CGGUGGGCUACACCGGAGC | 1739 |
| AD-70711 | ACCGGAGCCUUCUGCGACAdTdT | 1372 | UGUCGCAGAAGGCUCCGGUdTdT | 1556 | ACCGGAGCCUUCUGCGACG | 1740 |
| AD-70712 | UUCUGCGACGUGGACACCAdTdT | 1373 | UGGUGUCCACGUCGCAGAAdTdT | 1557 | UUCUGCGACGUGGACACCA | 1741 |
| AD-70713 | GACACCAAGGCAAGCUGCUdTdT | 1374 | AGCAGCUUGCCUUGGUGUCdTdT | 1558 | GACACCAAGGCAAGCUGCU | 1742 |
| AD-70714 | CAAGCUGCUAUGAUGGCCAdTdT | 1375 | UGGCCAUCAUAGCAGCUUGdTdT | 1559 | CAAGCUGCUAUGAUGGCCG | 1743 |
| AD-70715 | GAUGGCCGCGGGCUCAGCUdTdT | 1376 | AGCUGAGCCCGCGGCCAUCdTdT | 1560 | GAUGGCCGCGGGCUCAGCU | 1744 |
| AD-70716 | UCAGCUACCGCGGCCUGGAdTdT | 1377 | UCCAGGCCGCGGUAGCUGAdTdT | 1561 | UCAGCUACCGCGGCCUGGC | 1745 |
| AD-70717 | CGGCCUGGCCAGGACCACAdTdT | 1378 | UGUGGUCCUGGCCAGGCCGdTdT | 1562 | CGGCCUGGCCAGGACCACG | 1746 |
| AD-70718 | AGGACCACGCUCUCGGGUAdTdT | 1379 | UACCCGAGAGCGUGGUCCUdTdT | 1563 | AGGACCACGCUCUCGGGUG | 1747 |
| AD-70719 | UCGGGUGCGCCCUGUCAGAdTdT | 1380 | UCUGACAGGGCGCACCCGAdTdT | 1564 | UCGGGUGCGCCCUGUCAGC | 1748 |
| AD-70720 | CUGUCAGCCGUGGGCCUCAdTdT | 1381 | UGAGGCCCACGGCUGACAGdTdT | 1565 | CUGUCAGCCGUGGGCCUCG | 1749 |
| AD-70721 | UGGGCCUCGGAGGCCACCUdTdT | 1382 | AGGUGGCCUCCGAGGCCCAdTdT | 1566 | UGGGCCUCGGAGGCCACCU | 1750 |
| AD-70722 | CCACCUACCGGAACGUGAAdTdT | 1383 | UUCACGUUCCGGUAGGUGGdTdT | 1567 | CCACCUACCGGAACGUGAC | 1751 |
| AD-70723 | AACGUGACUGCCGAGCAAAdTdT | 1384 | UUUGCUCGGCAGUCACGUUdTdT | 1568 | AACGUGACUGCCGAGCAAG | 1752 |
| AD-70724 | CGAGCAAGCGCGGAACUGAdTdT | 1385 | UCAGUUCCGCGCUUGCUCGdTdT | 1569 | CGAGCAAGCGCGGAACUGG | 1753 |
| AD-70725 | CGGAACUGGGGACUGGGCAdTdT | 1386 | UGCCCAGUCCCCAGUUCCGdTdT | 1570 | CGGAACUGGGGACUGGGCG | 1754 |
| AD-70726 | GACUGGGCGGCCACGCCUUdTdT | 1387 | AAGGCGUGGCCGCCCAGUCdTdT | 1571 | GACUGGGCGGCCACGCCUU | 1755 |
| AD-70727 | ACGCCUUCUGCCGGAACCAdTdT | 1388 | UGGUUCCGGCAGAAGGCGUdTdT | 1572 | ACGCCUUCUGCCGGAACCC | 1756 |
| AD-70728 | CGGAACCCGGACAACGACAdTdT | 1389 | UGUCGUUGUCCGGGUUCCGdTdT | 1573 | CGGAACCCGGACAACGACA | 1757 |
| AD-70729 | AACGACAUCCGCCCGUGGUdTdT | 1390 | ACCACGGGCGGAUGUCGUUdTdT | 1574 | AACGACAUCCGCCCGUGGU | 1758 |
| AD-70730 | GCCCGUGGUGCUUCGUGCUdTdT | 1391 | AGCACGAAGCACCACGGGCdTdT | 1575 | GCCCGUGGUGCUUCGUGCU | 1759 |
| AD-70731 | UUCGUGCUGAACCGCGACAdTdT | 1392 | UGUCGCGGUUCAGCACGAAdTdT | 1576 | UUCGUGCUGAACCGCGACC | 1760 |
| AD-70732 | ACCGCGACCGGCUGAGCUAdTdT | 1393 | UAGCUCAGCCGGUCGCGGUdTdT | 1577 | ACCGCGACCGGCUGAGCUG | 1761 |
| AD-70733 | CUGAGCUGGGAGUACUGCAdTdT | 1394 | UGCAGUACUCCCAGCUCAGdTdT | 1578 | CUGAGCUGGGAGUACUGCG | 1762 |
| AD-70734 | UACUGCGACCUGGCACAGUdTdT | 1395 | ACUGUGCCAGGUCGCAGUAdTdT | 1579 | UACUGCGACCUGGCACAGU | 1763 |
| AD-70735 | UGGCACAGUGCCAGACCCAdTdT | 1396 | UGGGUCUGGCACUGUGCCAdTdT | 1580 | UGGCACAGUGCCAGACCCC | 1764 |
| AD-70736 | AGACCCCAACCCAGGCGGAdTdT | 1397 | UCCGCCUGGGUUGGGGUCUdTdT | 1581 | AGACCCCAACCCAGGCGGC | 1765 |

TABLE 21-continued

F12 Modified Sequences

| Duplex Name | Sense Sequence 5' to 3' | SEQ ID NO | Antisense Sequence 5' to 3' | SEQ ID NO | mRNA target sequence | SEQ ID NO |
|---|---|---|---|---|---|---|
| AD-70737 | AGGCGGCGCCUCCGACCCAdTdT | 1398 | UGGGUCGGAGGCGCCGCCUdTdT | 1582 | AGGCGGCGCCUCCGACCCC | 1766 |
| AD-70738 | UCCGACCCCGGUGUCCCCUdTdT | 1399 | AGGGGACACCGGGGUCGGAdTdT | 1583 | UCCGACCCCGGUGUCCCCU | 1767 |
| AD-70739 | UGUCCCCUAGGCUUCAUGUdTdT | 1400 | ACAUGAAGCCUAGGGGACAdTdT | 1584 | UGUCCCCUAGGCUUCAUGU | 1768 |
| AD-70740 | UUCAUGUCCCACUCAUGCAdTdT | 1401 | UGCAUGAGUGGGACAUGAAdTdT | 1585 | UUCAUGUCCCACUCAUGCC | 1769 |
| AD-70741 | ACUCAUGCCCGCGCAGCCAdTdT | 1402 | UGGCUGCGCGGGCAUGAGUdTdT | 1586 | ACUCAUGCCCGCGCAGCCG | 1770 |
| AD-70742 | CGCAGCCGGCACCGCCGAAdTdT | 1403 | UUCGGCGGUGCCGGCUGCGdTdT | 1587 | CGCAGCCGGCACCGCCGAA | 1771 |
| AD-70743 | ACCGCCGAAGCCUCAGCCAdTdT | 1404 | UGGCUGAGGCUUCGGCGGUdTdT | 1588 | ACCGCCGAAGCCUCAGCCC | 1772 |
| AD-70744 | UCAGCCCACGACCCGGACAdTdT | 1405 | UGUCCGGGUCGUGGGCUGAdTdT | 1589 | UCAGCCCACGACCCGGACC | 1773 |
| AD-70745 | ACCCGGACCCCGCCUCAGUdTdT | 1406 | ACUGAGGCGGGGUCCGGGUdTdT | 1590 | ACCCGGACCCCGCCUCAGU | 1774 |
| AD-70562 | CCUCAGUCCCAGACCCCGAdTdT | 1407 | UCGGGGUCUGGGACUGAGGdTdT | 1591 | CCUCAGUCCCAGACCCCGG | 1775 |
| AD-70563 | AGACCCCGGGAGCCUUGCAdTdT | 1408 | UGCAAGGCUCCCGGGGUCUdTdT | 1592 | AGACCCCGGGAGCCUUGCC | 1776 |
| AD-70564 | CCUUGCCGGCGAAGCGGGAdTdT | 1409 | UCCCGCUUCGCCGGCAAGGdTdT | 1593 | CCUUGCCGGCGAAGCGGGA | 1777 |
| AD-70565 | AAGCGGGAGCAGCCGCCUUdTdT | 1410 | AAGGCGGCUGCUCCCGCUUdTdT | 1594 | AAGCGGGAGCAGCCGCCUU | 1778 |
| AD-70566 | AGCCGCCUUCCCUGACCAAdTdT | 1411 | UUGGUCAGGGAAGGCGGCUdTdT | 1595 | AGCCGCCUUCCCUGACCAG | 1779 |
| AD-70567 | UGACCAGGAACGGCCCACUdTdT | 1412 | AGUGGGCCGUUCCUGGUCAdTdT | 1596 | UGACCAGGAACGGCCCACU | 1780 |
| AD-70568 | CGGCCCACUGAGCUGCGGAdTdT | 1413 | UCCGCAGCUCAGUGGGCCGdTdT | 1597 | CGGCCCACUGAGCUGCGGG | 1781 |
| AD-70569 | UGCGGGCAGCGGCUCCGCAdTdT | 1414 | UGCGGAGCCGCUGCCCGCAdTdT | 1598 | UGCGGGCAGCGGCUCCGCA | 1782 |
| AD-70570 | CGGCUCCGCAAGAGUCUGUdTdT | 1415 | ACAGACUCUUGCGGAGCCGdTdT | 1599 | CGGCUCCGCAAGAGUCUGU | 1783 |
| AD-70571 | AGUCUGUCUUCGAUGACCAdTdT | 1416 | UGGUCAUCGAAGACAGACUdTdT | 1600 | AGUCUGUCUUCGAUGACCC | 1784 |
| AD-70572 | CGAUGACCCGCGUCGUUGAdTdT | 1417 | UCAACGACGCGGGUCAUCGdTdT | 1601 | CGAUGACCCGCGUCGUUGG | 1785 |
| AD-70573 | UCGUUGGCGGGCUGGUGGAdTdT | 1418 | UCCACCAGCCCGCCAACGAdTdT | 1602 | UCGUUGGCGGGCUGGUGGC | 1786 |
| AD-70574 | UGGUGGCGCUACGCGGGGAdTdT | 1419 | UCCCCGCGUAGCGCCACCAdTdT | 1603 | UGGUGGCGCUACGCGGGGC | 1787 |
| AD-70575 | UACGCGGGGCGCACCCCUAdTdT | 1420 | UAGGGGUGCGCCCCGCGUAdTdT | 1604 | UACGCGGGGCGCACCCCUA | 1788 |
| AD-70576 | ACCCCUACAUCGCCGCGCUdTdT | 1421 | AGCGCGGCGAUGUAGGGGUdTdT | 1605 | ACCCCUACAUCGCCGCGCU | 1789 |
| AD-70577 | GCCGCGCUGUACUGGGGCAdTdT | 1422 | UGCCCCAGUACAGCGCGGCdTdT | 1606 | GCCGCGCUGUACUGGGGCC | 1790 |
| AD-70578 | CUGGGGCCACAGUUUCUGAdTdT | 1423 | UCAGAAACUGUGGCCCCAGdTdT | 1607 | CUGGGGCCACAGUUUCUGC | 1791 |
| AD-70579 | UUUCUGCGCCGGCAGCCUAdTdT | 1424 | UAGGCUGCCGGCGCAGAAAdTdT | 1608 | UUUCUGCGCCGGCAGCCUC | 1792 |
| AD-70580 | CGGCAGCCUCAUCGCCCCAdTdT | 1425 | UGGGGCGAUGAGGCUGCCGdTdT | 1609 | CGGCAGCCUCAUCGCCCCC | 1793 |
| AD-70581 | UCGCCCCUGCUGGGUGCUdTdT | 1426 | AGCACCCAGCAGGGGCGAdTdT | 1610 | UCGCCCCUGCUGGGUGCU | 1794 |
| AD-70582 | UGGGUGCUGACGGCCGCUAdTdT | 1427 | UAGCGGCCGUCAGCACCCAdTdT | 1611 | UGGGUGCUGACGGCCGCUC | 1795 |
| AD-70583 | GCCGCUCACUGCCUGCAGAdTdT | 1428 | UCUGCAGGCAGUGAGCGGCdTdT | 1612 | GCCGCUCACUGCCUGCAGG | 1796 |
| AD-70584 | CUGCAGGACCGGCCCGCAAdTdT | 1429 | UUGCGGGCCGGUCCUGCAGdTdT | 1613 | CUGCAGGACCGGCCCGCAC | 1797 |
| AD-70585 | GGCCCGCACCCGAGGAUCUdTdT | 1430 | AGAUCCUCGGGUGCGGGCCdTdT | 1614 | GGCCCGCACCCGAGGAUCU | 1798 |
| AD-70586 | CGAGGAUCUGACGGUGGUAdTdT | 1431 | UACCACCGUCAGAUCCUCGdTdT | 1615 | CGAGGAUCUGACGGUGGUG | 1799 |
| AD-70587 | GUGGUGCUCGGCCAGGAAAdTdT | 1432 | UUUCCUGGCCGAGCACCAcdTdT | 1616 | GUGGUGCUCGGCCAGGAAC | 1800 |
| AD-70588 | GCCAGGAACGCCGUAACCAdTdT | 1433 | UGGUUACGGCGUUCCUGGCdTdT | 1617 | GCCAGGAACGCCGUAACCA | 1801 |
| AD-70589 | CGUAACCACAGCUGUGAGAdTdT | 1434 | UCUCACAGCUGUGGUUACGdTdT | 1618 | CGUAACCACAGCUGUGAGC | 1802 |

TABLE 21-continued

F12 Modified Sequences

| Duplex Name | Sense Sequence 5' to 3' | SEQ ID NO | Antisense Sequence 5' to 3' | SEQ ID NO | mRNA target sequence | SEQ ID NO |
|---|---|---|---|---|---|---|
| AD-70590 | UGUGAGCCGUGCCAGACGUdTdT | 1435 | ACGUCUGGCACGGCUCACAdTdT | 1619 | UGUGAGCCGUGCCAGACGU | 1803 |
| AD-70591 | UGCCAGACGUUGGCCGUGAdTdT | 1436 | UCACGGCCAACGUCUGGCAdTdT | 1620 | UGCCAGACGUUGGCCGUGC | 1804 |
| AD-70592 | GCCGUGCGCUCCUACCGCUdTdT | 1437 | AGCGGUAGGAGCGCACGGCdTdT | 1621 | GCCGUGCGCUCCUACCGCU | 1805 |
| AD-70593 | UACCGCUUGCACGAGGCCUdTdT | 1438 | AGGCCUCGUGCAAGCGGUAdTdT | 1622 | UACCGCUUGCACGAGGCCU | 1806 |
| AD-70594 | ACGAGGCCUUCUCGCCCGUdTdT | 1439 | ACGGGCGAGAAGGCCUCGUdTdT | 1623 | ACGAGGCCUUCUCGCCCGU | 1807 |
| AD-70595 | UCGCCCGUCAGCUACCAGAdTdT | 1440 | UCUGGUAGCUGACGGGCGAdTdT | 1624 | UCGCCCGUCAGCUACCAGC | 1808 |
| AD-70596 | CUACCAGCACGACCUGGCUdTdT | 1441 | AGCCAGGUCGUGCUGGUAGdTdT | 1625 | CUACCAGCACGACCUGGCU | 1809 |
| AD-70597 | ACCUGGCUCUGUUGCGCCUdTdT | 1442 | AGGCGCAACAGAGCCAGGUdTdT | 1626 | ACCUGGCUCUGUUGCGCCU | 1810 |
| AD-70598 | UUGCGCCUUCAGGAGGAUdTdT | 1443 | UAUCCUCCUGAAGGCGCAAdTdT | 1627 | UUGCGCCUUCAGGAGGAUG | 1811 |
| AD-70599 | GAGGAUGCGGACGGCAGCUdTdT | 1444 | AGCUGCCGUCCGCAUCCUCdTdT | 1628 | GAGGAUGCGGACGGCAGCU | 1812 |
| AD-70600 | ACGGCAGCUGCGCGCUCCUdTdT | 1445 | AGGAGCGCGCAGCUGCCGUdTdT | 1629 | ACGGCAGCUGCGCGCUCCU | 1813 |
| AD-70601 | CGCUCCUGUCGCCUUACGUdTdT | 1446 | ACGUAAGGCGACAGGAGCGdTdT | 1630 | CGCUCCUGUCGCCUUACGU | 1814 |
| AD-70602 | CCUUACGUUCAGCCGGUGUdTdT | 1447 | ACACCGGCUGAACGUAAGGdTdT | 1631 | CCUUACGUUCAGCCGGUGU | 1815 |
| AD-70603 | AGCCGGUGUGCCUGCCAAAdTdT | 1448 | UUUGGCAGGCACACCGGCUdTdT | 1632 | AGCCGGUGUGCCUGCCAAG | 1816 |
| AD-70604 | UGCCAAGCGGCGCCGCGCAdTdT | 1449 | UGCGCGGCGCCGCUUGGCAdTdT | 1633 | UGCCAAGCGGCGCCGCGCG | 1817 |
| AD-70605 | GCGCCGCGCGACCCUCCGAdTdT | 1450 | UCGGAGGGUCGCGCGGCGCdTdT | 1634 | GCGCCGCGCGACCCUCCGA | 1818 |
| AD-70606 | CCCUCCGAGACCACGCUCUdTdT | 1451 | AGAGCGUGGUCUCGGAGGGdTdT | 1635 | CCCUCCGAGACCACGCUCU | 1819 |
| AD-70607 | CGCUCUGCCAGGUGGCCGAdTdT | 1452 | UCGGCCACCUGGCAGAGCGdTdT | 1636 | CGCUCUGCCAGGUGGCCGG | 1820 |
| AD-70608 | AGGUGGCCGGCUGGGGCCAdTdT | 1453 | UGGCCCCAGCCGGCCACCUdTdT | 1637 | AGGUGGCCGGCUGGGGCCA | 1821 |
| AD-70609 | UGGGGCCACCAGUUCGAGAdTdT | 1454 | UCUCGAACUGGUGGCCCCAdTdT | 1638 | UGGGGCCACCAGUUCGAGG | 1822 |
| AD-70610 | UUCGAGGGGCGGAGGAAUdTdT | 1455 | AUUCCUCCGCCCCUCGAAdTdT | 1639 | UUCGAGGGGCGGAGGAAU | 1823 |
| AD-70611 | CGGAGGAAUAUGCCAGCUUdTdT | 1456 | AAGCUGGCAUAUUCCUCCGdTdT | 1640 | CGGAGGAAUAUGCCAGCUU | 1824 |
| AD-70612 | CAGCUUCCUGCAGGAGGCAdTdT | 1457 | UGCCUCCUGCAGGAAGCUGdTdT | 1641 | CAGCUUCCUGCAGGAGGCG | 1825 |
| AD-70613 | AGGAGGCGCAGGUACCGUUdTdT | 1458 | AACGGUACCUGCGCCUCCUdTdT | 1642 | AGGAGGCGCAGGUACCGUU | 1826 |
| AD-70614 | AGGUACCGUUCCUCUCCCUdTdT | 1459 | AGGGAGAGGAACGGUACCUdTdT | 1643 | AGGUACCGUUCCUCUCCCU | 1827 |
| AD-70615 | CUCUCCCUGGAGCGCUGCUdTdT | 1460 | AGCAGCGCUCCAGGGAGAGdTdT | 1644 | CUCUCCCUGGAGCGCUGCU | 1828 |
| AD-70616 | CGCUGCUCAGCCCCGGACAdTdT | 1461 | UGUCCGGGGCUGAGCAGCGdTdT | 1645 | CGCUGCUCAGCCCCGGACG | 1829 |
| AD-70617 | CCGGACGUGCACGGAUCCUdTdT | 1462 | AGGAUCCGUGCACGUCCGGdTdT | 1646 | CCGGACGUGCACGGAUCCU | 1830 |
| AD-70618 | CGGAUCCUCCAUCCUCCCAdTdT | 1463 | UGGGAGGAUGGAGGAUCCGdTdT | 1647 | CGGAUCCUCCAUCCUCCCC | 1831 |
| AD-70619 | CAUCCUCCCGGCAUGCUdTdT | 1464 | UAGCAUGCCGGGGAGGAUdTdT | 1648 | CAUCCUCCCCGGCAUGCUC | 1832 |
| AD-70620 | CAUGCUCUGCGCAGGGUUAdTdT | 1465 | UAACCCUGCGCAGAGCAUGdTdT | 1649 | CAUGCUCUGCGCAGGGUUC | 1833 |
| AD-70621 | AGGGUUCUCGAGGGCGGAdTdT | 1466 | UCCGCCCUCGAGGAACCCUdTdT | 1650 | AGGGUUCCUCGAGGGCGGC | 1834 |
| AD-70622 | GAGGGCGGCACCGAUGCGUdTdT | 1467 | ACGCAUCGGUGCCGCCCUCdTdT | 1651 | GAGGGCGGCACCGAUGCGU | 1835 |
| AD-70623 | GAUGCGUGCCAGGGUGAUUdTdT | 1468 | AAUCACCCUGGCACGCAUCdTdT | 1652 | GAUGCGUGCCAGGGUGAUU | 1836 |
| AD-70624 | AGGGUGAUUCCGGAGGCCAdTdT | 1469 | UGGCCUCCGGAAUCACCCUdTdT | 1653 | AGGGUGAUUCCGGAGGCCC | 1837 |
| AD-70625 | CGGAGGCCCGCUGGUGUGUdTdT | 1470 | ACACACCAGCGGGCCUCCGdTdT | 1654 | CGGAGGCCCGCUGGUGUGU | 1838 |
| AD-70626 | GGUGUGUGAGGACCAAGCUdTdT | 1471 | AGCUUGGUCCUCACACACCdTdT | 1655 | GGUGUGUGAGGACCAAGCU | 1839 |
| AD-70627 | CCAAGCUGCAGAGCGCCGAdTdT | 1472 | UCGGCGCUCUGCAGCUUGGdTdT | 1656 | CCAAGCUGCAGAGCGCCGG | 1840 |

TABLE 21-continued

F12 Modified Sequences

| Duplex Name | Sense Sequence 5' to 3' | SEQ ID NO | Antisense Sequence 5' to 3' | SEQ ID NO | mRNA target sequence | SEQ ID NO |
|---|---|---|---|---|---|---|
| AD-70628 | AGAGCGCCGGCUCACCCUAdTdT | 1473 | UAGGGUGAGCCGGCGCUCUdTdT | 1657 | AGAGCGCCGGCUCACCCUG | 1841 |
| AD-70629 | UCACCCUGCAAGGCAUCAUdTdT | 1474 | AUGAUGCCUUGCAGGGUGAdTdT | 1658 | UCACCCUGCAAGGCAUCAU | 1842 |
| AD-70630 | GGCAUCAUCAGCUGGGGAUdTdT | 1475 | AUCCCCAGCUGAUGAUGCCdTdT | 1659 | GGCAUCAUCAGCUGGGGAU | 1843 |
| AD-70631 | CUGGGGAUCGGGCUGUGGUdTdT | 1476 | ACCACAGCCCGAUCCCCAGdTdT | 1660 | CUGGGGAUCGGGCUGUGGU | 1844 |
| AD-70632 | UGUGGUGACCGCAACAAGdTdT | 1477 | UCUUGUUGCGGUCACCACAdTdT | 1661 | UGUGGUGACCGCAACAAGC | 1845 |
| AD-70633 | CAACAAGCCAGGCGUCUAdTdT | 1478 | UUAGACGCCUGGCUUGUUGdTdT | 1662 | CAACAAGCCAGGCGUCUAC | 1846 |
| AD-70634 | AGGCGUCUACACCGAUGUdTdT | 1479 | UACAUCGGUGUAGACGCCUdTdT | 1663 | AGGCGUCUACACCGAUGUG | 1847 |
| AD-70635 | GAUGUGGCCUACUACCUGAdTdT | 1480 | UCAGGUAGUAGGCCACAUCdTdT | 1664 | GAUGUGGCCUACUACCUGG | 1848 |
| AD-70636 | UACUACCUGGCCUGGAUCdTdT | 1481 | UGAUCCAGGCCAGGUAGUAdTdT | 1665 | UACUACCUGGCCUGGAUCC | 1849 |
| AD-70637 | CUGGAUCCGGGAGCACACAdTdT | 1482 | UGUGUGCUCCCGGAUCCAGdTdT | 1666 | CUGGAUCCGGGAGCACACC | 1850 |
| AD-70638 | AGCACACCGUUUCCUGAUUdTdT | 1483 | AAUCAGGAAACGGUGUGCUdTdT | 1667 | AGCACACCGUUUCCUGAUU | 1851 |
| AD-70639 | UCCUGAUUGCUCAGGGACUdTdT | 1484 | AGUCCCUGAGCAAUCAGGAdTdT | 1668 | UCCUGAUUGCUCAGGGACU | 1852 |
| AD-70640 | CAGGGACUCAUCUUUCCCUdTdT | 1485 | AGGGAAAGAUGAGUCCCUGdTdT | 1669 | CAGGGACUCAUCUUUCCCU | 1853 |
| AD-70641 | UUUCCCUCCUUGGUGAUUAdTdT | 1486 | UAAUCACCAAGGAGGGAAAdTdT | 1670 | UUUCCCUCCUUGGUGAUUC | 1854 |
| AD-70642 | UGGUGAUUCCGCAGUGAGAdTdT | 1487 | UCUCACUGCGGAAUCACCAdTdT | 1671 | UGGUGAUUCCGCAGUGAGA | 1855 |
| AD-70643 | AGUGAGAGAGUGGCUGGGAdTdT | 1488 | UCCCAGCCACUCUCUCACUdTdT | 1672 | AGUGAGAGAGUGGCUGGGG | 1856 |
| AD-70644 | GCUGGGGCAUGGAAGGCAAdTdT | 1489 | UUGCCUUCCAUGCCCCAGCdTdT | 1673 | GCUGGGGCAUGGAAGGCAA | 1857 |
| AD-70645 | UGGAAGGCAAGAUUGUGUAdTdT | 1490 | UACACAAUCUUGCCUUCCAdTdT | 1674 | UGGAAGGCAAGAUUGUGUC | 1858 |
| AD-70646 | UUGUGUCCCAUUCCCCCAAdTdT | 1491 | UUGGGGGAAUGGGACACAAdTdT | 1675 | UUGUGUCCCAUUCCCCCAG | 1859 |
| AD-70647 | UCCCCCAGUGCGGCCAGCUdTdT | 1492 | AGCUGGCCGCACUGGGGGAdTdT | 1676 | UCCCCCAGUGCGGCCAGCU | 1860 |
| AD-70648 | GCCAGCUCCGCGCCAGGAUdTdT | 1493 | AUCCUGGCGCGGAGCUGGCdTdT | 1677 | GCCAGCUCCGCGCCAGGAU | 1861 |
| AD-70649 | GCCAGGAUGGCGCAGGAAAdTdT | 1494 | UUUCCUGCGCCAUCCUGGCdTdT | 1678 | GCCAGGAUGGCGCAGGAAC | 1862 |
| AD-70650 | GCAGGAACUCAAUAAAGUdTdT | 1495 | UACUUUAUUGAGUUCCUGCdTdT | 1679 | GCAGGAACUCAAUAAAGUG | 1863 |
| AD-70651 | AAUAAAGUGCUUUGAAAAUdTdT | 1496 | AUUUUCAAAGCACUUUAUUdTdT | 1680 | AAUAAAGUGCUUUGAAAAU | 1864 |
| AD-70652 | UUGAAAAUGCUGAGAAAAAdTdT | 1497 | UUUUUCUCAGCAUUUUCAAdTdT | 1681 | UUGAAAAUGCUGAGAAAAA | 1865 |

TABLE 22

F12 Single Dose Screen in Hep3b Cells

| Duplex Name | AVG | STDEV |
|---|---|---|
| AD-70653 | 75.05 | 21.99 |
| AD-70654 | 59.86 | 17.07 |
| AD-70655 | 49.58 | 5.13 |
| AD-70656 | 42.85 | 9.76 |
| AD-70657 | 40.2 | 6.21 |
| AD-70658 | 52.43 | 13.02 |
| AD-70659 | 34.67 | 3.33 |
| AD-70660 | 33.59 | 8.28 |
| AD-70661 | 53.13 | 11.32 |
| AD-70662 | 61.89 | 7.76 |
| AD-70663 | 48.43 | 6.92 |
| AD-70664 | 34.42 | 4.01 |
| AD-70665 | 33.22 | 4.21 |
| AD-70666 | 33.44 | 5.89 |
| AD-70667 | 47.6 | 10.96 |
| AD-70668 | 125.01 | 38.32 |
| AD-70669 | 64.78 | 12.71 |
| AD-70670 | 57.49 | 5.4 |
| AD-70671 | 30.06 | 7.8 |
| AD-70672 | 54.95 | 2.39 |
| AD-70673 | 79.79 | 10.29 |
| AD-70674 | 88.3 | 12.07 |
| AD-70675 | 55.83 | 14.88 |
| AD-70676 | 61.99 | 12.96 |
| AD-70677 | 50.27 | 9.84 |
| AD-70678 | 65.84 | 10.37 |
| AD-70679 | 51.1 | 8.97 |
| AD-70680 | 64.71 | 10.54 |
| AD-70681 | 41.02 | 6.75 |
| AD-70682 | 60.65 | 9.01 |

TABLE 22-continued

F12 Single Dose Screen in Hep3b Cells

| Duplex Name | AVG | STDEV |
|---|---|---|
| AD-70683 | 96.74 | 6.29 |
| AD-70684 | 71.16 | 13.22 |
| AD-70685 | 99.97 | 12.48 |
| AD-70686 | 45.51 | 6.21 |
| AD-70687 | 68.37 | 5.36 |
| AD-70688 | 65.68 | 6.4 |
| AD-70689 | 63.41 | 5.72 |
| AD-70690 | 54.1 | 7.23 |
| AD-70691 | 43.79 | 11.91 |
| AD-70692 | 51.36 | 8.64 |
| AD-70693 | 43.25 | 7.81 |
| AD-70694 | 51.13 | 4.52 |
| AD-70695 | 47.38 | 4.76 |
| AD-70696 | 63.08 | 3.96 |
| AD-70697 | 49.53 | 6.44 |
| AD-70698 | 56.12 | 8.22 |
| AD-70699 | 53.68 | 4.62 |
| AD-70700 | 68.45 | 12.64 |
| AD-70701 | 94.45 | 11.32 |
| AD-70702 | 70.82 | 8.36 |
| AD-70703 | 93.79 | 7.87 |
| AD-70704 | 35.84 | 4.09 |
| AD-70705 | 87.79 | 5.74 |
| AD-70706 | 59.21 | 9.08 |
| AD-70707 | 64.22 | 10.1 |
| AD-70708 | 49.55 | 3 |
| AD-70709 | 87.37 | 7.17 |
| AD-70710 | 76.54 | 11.55 |
| AD-70711 | 62.4 | 4.69 |
| AD-70712 | 80.45 | 8.12 |
| AD-70713 | 76.68 | 16.28 |
| AD-70714 | 61.92 | 15.07 |
| AD-70715 | 85.76 | 8.24 |
| AD-70716 | 97.67 | 8.1 |
| AD-70717 | 70.83 | 2.72 |
| AD-70718 | 50.19 | 9.69 |
| AD-70719 | 77.23 | 4.82 |
| AD-70720 | 69.02 | 6.52 |
| AD-70721 | 84.91 | 12.03 |
| AD-70722 | 42.64 | 6.44 |
| AD-70723 | 56.77 | 6.73 |
| AD-70724 | 50.28 | 7.37 |
| AD-70725 | 73.06 | 14.77 |
| AD-70726 | 69.29 | 8.43 |
| AD-70727 | 68.98 | 5.88 |
| AD-70728 | 59.51 | 5.26 |
| AD-70729 | 77.31 | 11.18 |
| AD-70730 | 48.22 | 9.04 |
| AD-70731 | 63.52 | 3.78 |
| AD-70732 | 60.89 | 6.26 |
| AD-70733 | 55.56 | 13.83 |
| AD-70734 | 110.37 | 7.09 |
| AD-70735 | 70.96 | 1.41 |
| AD-70736 | 72.71 | 4.28 |
| AD-70737 | 66.94 | 4.75 |
| AD-70738 | 104.61 | 9.8 |
| AD-70739 | 87.48 | 8.44 |
| AD-70740 | 69.08 | 9.31 |
| AD-70741 | 67.82 | 3.49 |
| AD-70742 | 92.93 | 14.66 |
| AD-70743 | 59.32 | 9.95 |
| AD-70744 | 81.97 | 6.05 |
| AD-70745 | 54.96 | 7.81 |
| AD-70562 | 46.21 | 8.44 |
| AD-70563 | 44.88 | 5.69 |
| AD-70564 | 67.82 | 20.32 |
| AD-70565 | 52.32 | 12.39 |
| AD-70566 | 53.22 | 10.43 |
| AD-70567 | 46.28 | 10.21 |
| AD-70568 | 41.84 | 3.91 |
| AD-70569 | 46.27 | 10.51 |
| AD-70570 | 37.31 | 7.6 |
| AD-70571 | 55.84 | 13.93 |
| AD-70572 | 64.38 | 6.03 |
| AD-70573 | 75.03 | 17.72 |
| AD-70574 | 61.2 | 7.6 |
| AD-70575 | 55.54 | 18.99 |
| AD-70576 | 48.67 | 7.52 |
| AD-70577 | 34.12 | 10.23 |
| AD-70578 | 56.62 | 6.22 |
| AD-70579 | 58.22 | 17.32 |
| AD-70580 | 64.99 | 8.66 |
| AD-70581 | 86.55 | 15.76 |
| AD-70582 | 72.76 | 11.98 |
| AD-70583 | 47.99 | 20.51 |
| AD-70584 | 54 | 14.12 |
| AD-70585 | 43.72 | 6.69 |
| AD-70586 | 55.96 | 12.05 |
| AD-70587 | 64.82 | 18.43 |
| AD-70588 | 66.06 | 13.08 |
| AD-70589 | 56.65 | 10.27 |
| AD-70590 | 77.82 | 4.75 |
| AD-70591 | 68.65 | 9.93 |
| AD-70592 | 37.1 | 9.84 |
| AD-70593 | 50.14 | 17.24 |
| AD-70594 | 50.16 | 13.61 |
| AD-70595 | 60.63 | 13.54 |
| AD-70596 | 80.78 | 12.29 |
| AD-70597 | 60.74 | 21.94 |
| AD-70598 | 70.51 | 8.48 |
| AD-70599 | 67.75 | 7.59 |
| AD-70600 | 68.09 | 31.51 |
| AD-70601 | 53.28 | 21.16 |
| AD-70602 | 44.03 | 10.56 |
| AD-70603 | 87.08 | 40.51 |
| AD-70604 | 69.39 | 9.62 |
| AD-70605 | 86.92 | 27.74 |
| AD-70606 | 62.19 | 7.28 |
| AD-70607 | 67.55 | 19.57 |
| AD-70608 | 98.46 | 10.23 |
| AD-70609 | 77.67 | 10.72 |
| AD-70610 | 108.45 | 21.97 |
| AD-70611 | 73.02 | 19.12 |
| AD-70612 | 97.49 | 26.26 |
| AD-70613 | 65.22 | 19.24 |
| AD-70614 | 96.69 | 21.51 |
| AD-70615 | 76.53 | 7.96 |
| AD-70616 | 69.73 | 12.06 |
| AD-70617 | 58.38 | 10.85 |
| AD-70618 | 73.89 | 22.5 |
| AD-70619 | 85.32 | 25.92 |
| AD-70620 | 72.03 | 33.04 |
| AD-70621 | 83.22 | 24.59 |
| AD-70622 | 108.98 | 14.93 |
| AD-70623 | 71.28 | 32.49 |
| AD-70624 | 67.8 | 25.27 |
| AD-70625 | 52.08 | 10.91 |
| AD-70626 | 40.94 | 13.75 |
| AD-70627 | 33.55 | 3.35 |
| AD-70628 | 52.37 | 10.46 |
| AD-70629 | 53.46 | 4.07 |
| AD-70630 | 47 | 8.42 |
| AD-70631 | 64.51 | 42.23 |
| AD-70632 | 30.66 | 4.32 |
| AD-70633 | 33.64 | 12.21 |
| AD-70634 | 65.42 | 6.92 |
| AD-70635 | 45.84 | 6.76 |
| AD-70636 | 47.83 | 6.63 |
| AD-70637 | 64.39 | 8.42 |
| AD-70638 | 38.91 | 8.35 |
| AD-70639 | 40.87 | 7.79 |
| AD-70640 | 50.87 | 13.34 |
| AD-70641 | 49.64 | 5.85 |
| AD-70642 | 44.04 | 8.02 |
| AD-70643 | 61.04 | 11.12 |
| AD-70644 | 50.03 | 9.07 |
| AD-70645 | 67.35 | 28.98 |
| AD-70646 | 50.93 | 6 |
| AD-70647 | 83.29 | 5.96 |
| AD-70648 | 53.57 | 15.44 |
| AD-70649 | 46.35 | 8.99 |
| AD-70650 | 52.06 | 7.83 |

TABLE 22-continued

F12 Single Dose Screen in Hep3b Cells

| Duplex Name | AVG | STDEV |
|---|---|---|
| AD-70651 | 64.65 | 9.04 |
| AD-70652 | 100.8 | 9.21 |

Example 11. In Vivo F12 Silencing in Mustard Oil-Induced Vascular Permeability Mouse Model As discussed above and demonstrated in FIGS. 2 and 5, AD-67244 was the most efficacious agent targeting an F12 gene that was tested, resulting in robust, dose-dependent reduction of F12 mRNA and plasma F12 protein in wild-type mice, and normalization of vascular permeability in a bradykinin-induced vascular leakage mouse model of HAE (the ACE-inhibitor-induced mouse model).

The in vivo efficacy of AD-67244 was also assessed in a second mouse model of HAE. In particular, the ability of AD-67244 to rescue mustard oil-induced vascular permeability in C1-INH deficient mice was determined by subcutaneously administering CD-1 female mice (n=10/group) a single 3 mg/kg, 0.5 mg/kg, or 0.1 mg/kg dose of AD-67244 in combination with a single 10 mg/kg dose of a double stranded RNA agent targeting C1-INH at day −7. On Day 0, Evans Blue dye (30 mg/kg) was injected into the tail vein of the animals and a 5% solution of mustard oil was topically applied to the right ear of each animal (the left ear was left untreated and served as a control). Thirty minutes later, the animals were sacrificed, each ear was collected for dye extravasation to determine vascular permeability, and livers were collected for F12 and C1-INH mRNA measurements.

Figures 10A, 10B:
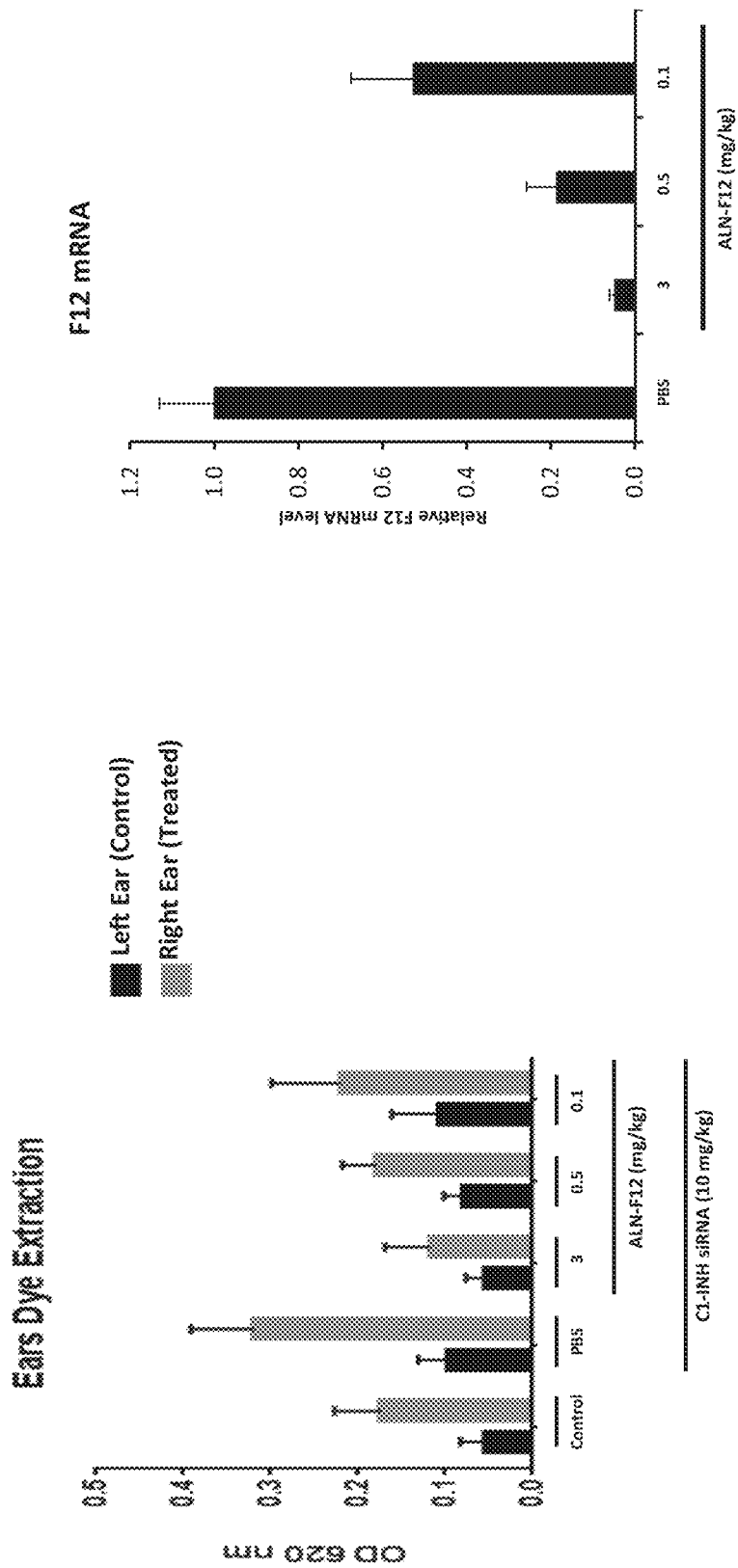
FIG. 10A is a graph depicting the amount of Evans blue dye in the ears of mice administered a single 0.1 mg/kg, 0.5 mg/kg, or 3 mg/kg dose of AD-67244 in combination with a single 10 mg/kg dose of a dsRNA agent targeting C1-INH at day 7 post-dose. Error bars=standard deviation.
FIG. 10B is a graph depicting dose-dependent F12 mRNA suppression following a single subcutaneous 0.1 mg/kg, 0.5 mg/kg, or 3 mg/kg dose of AD-67244 in combination with a single 10 mg/kg dose of a dsRNA agent targeting C1-INH at day 7 post-dose.

As shown in FIG. 10A, administration of a single 3 mg/kg, 0.5 mg/kg, or 0.1 mg/kg dose of AD-67244 normalized vascular permeability in these mice and, as shown in FIG. 10B, this administration resulted in robust, dose-dependent reduction of F12 mRNA in the livers of these animals. The level of C1-INH in the livers of these animals was less than 0.01% of the level of C1-INH in the livers of the control group administered. These data demonstrate that AD-67244 can mitigate excess bradykinin stimulation.

Example 12. In Vivo F12 Silencing in Non-Human Primates

Figure 11:
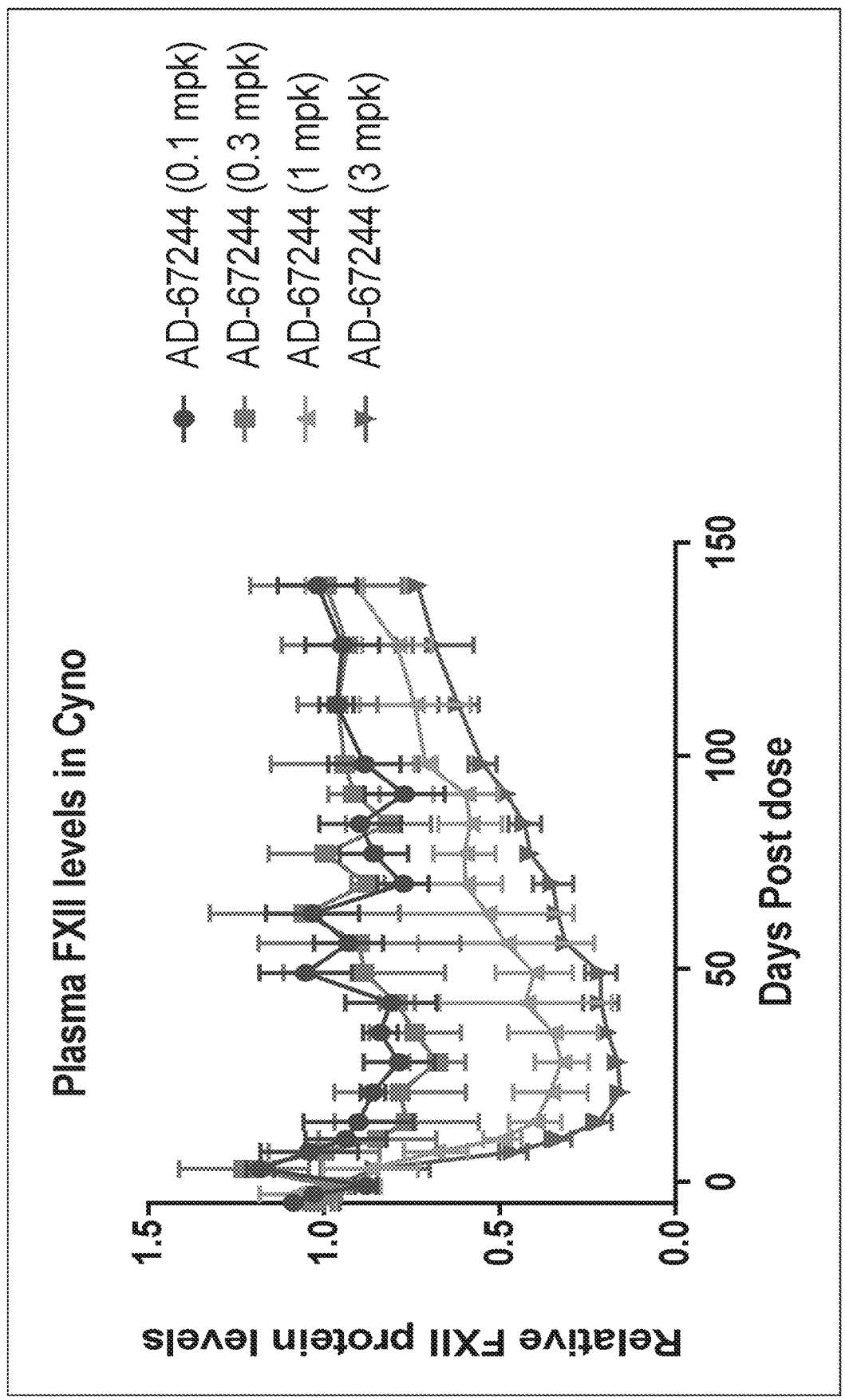
FIG. 11 is a graph depicting F12 protein suppression in the plasma of female Cynomolgus monkeys subcutaeoulsy administered a single 3 mg/kg, 1 mg/kg, 0.3 mg/kg, or 0.1 mg/kg dose of AD-67244. The plasma F12 levels shown are the relative F12 protein levels which were normalized to the average pre-dose baseline F12 protein level. Error bars=standard deviation.

To determine the efficacy of AD-67244 in non-human primates, female Cynomolgus monkeys (n=3 per group) were subcutaneously administered a single 3 mg/kg, 1 mg/kg, 0.3 mg/kg, or 0.1 mg/kg dose of AD-67244. The level of Cynomolgus F12 plasma protein levels was measured by ELISA at days −5, −3, −1, 3, 7, 10, 14, 21, 28, 35, 42, 49, 56, 63, 70, 77, 84, 91, 98, 112, 126, and 140 post-dose. FIG. 11 demonstrates that administration of a single 0.3 mg/kg dose of AD-67244 resulted in greater than 85% reduction in F12 protein. FIG. 11 also demonstrates that this reduction in F12 protein was durable with greater than 70% and 50% reduction at 2 and 3 months post-dose, respectively.

Example 13. Effect of 5' Modification of AD-67244 on Potency in Mice

Figure 12:
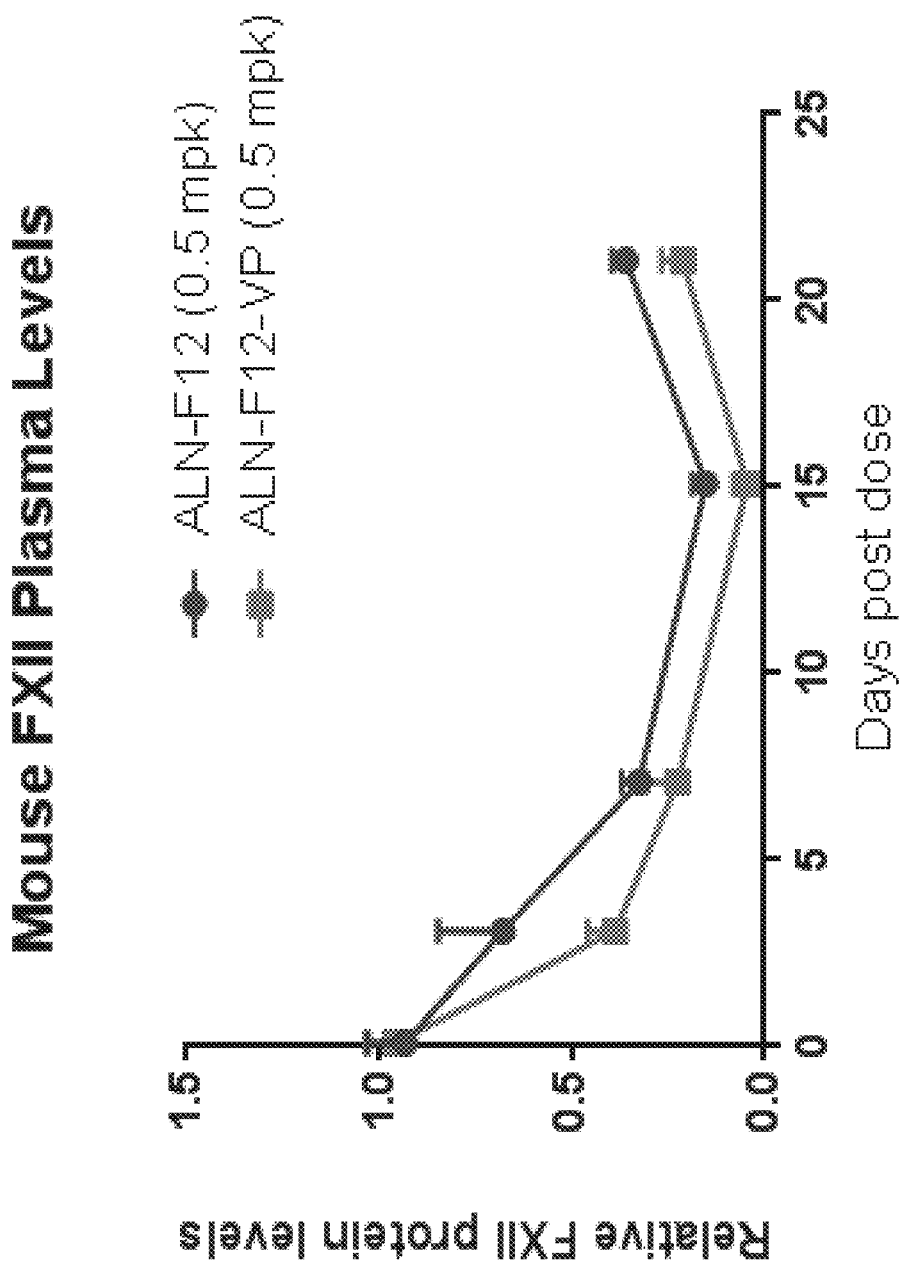
FIG. 12 is a graph depicting F12 protein suppression in the plasma of wild-type mice administered a single 0.5 mg/kg dose of either AD-67244 or AD-74841.

The effect of modifying the 5' antisense phosphate of AD-67244 with a vinylphosphate (VP) on the potency of the agent was determined in mice. Wild-type mice (n=3/group) were administered a single 0.5 mg/kg dose of either AD-67244 (sense: 5'-asascucaAfuAfAfAfgugcuuugaa-3' (SEQ ID NO: 1866); antisense: 5'-usUfscaaAfgCfAfcuuuAfuUfgaguususc-3' (SEQ ID NO: 1867); ALN-F12) or AD-74841 (sense: 5'-asascucaAfuAfAfAfgugcuuugaa-3' (SEQ ID NO: 1868); antisense: 5'-VP-usUfscaaAfgCfAfcuuuAfuUfgaguususc-3' (SEQ ID NO: 1869); ALN-F12-VP). The plasma level of F12 protein was determined by ELISA at days 0, 3, 7, 15, and 21 post-dose. FIG. 12 demonstrates that 5' modification of the antisense phosphate group with a vinylphosphate moderately increased the potency of AD-67244.

Example 14. Synthesis and In Vitro Screening of F12 siRNA Duplexes

Additional iRNA agents targeting F12, e.g., targeting about nucleotides 2000-2060 of SEQ ID NO:9, were designed, synthesized, and screened for in vitro efficacy, as described above. A detailed list of the additional unmodified F12 sense and antisense strand sequences is shown in Table 23. A detailed list of the additional modified F12 sense and antisense strand sequences is shown in Table 24. Table 25 provides the results of a single dose screen in Hep3b cells transfected with the indicated additional F12 iRNAs. Data are expressed as percent of mRNA remaining relative to AD-1955.

TABLE 23

F12 Unmodified Sequences

| Duplex Name | Sense Sequence 5' to 3' | SEQ ID NO | Range in SEQ ID NO: 9 | Antisense Sequence 5' to 3' | SEQ ID NO | Range in SEQ ID NO: 9 |
|---|---|---|---|---|---|---|
| AD-70649.2 | GCCAGGAUGGCGCAGGAAA | 1870 | 2004-2022 | UUUCCUGCGCCAUCCUGGC | 1908 | 2004-2022 |
| AD-75921.1 | CCAGGAUGGCGCAGGAACU | 1871 | 2005-2023 | AGUUCCUGCGCCAUCCUGG | 1909 | 2005-2023 |
| AD-75920.1 | CAGGAUGGCGCAGGAACUA | 1872 | 2006-2024 | UAGUUCCUGCGCCAUCCUG | 1910 | 2006-2024 |
| AD-75919.1 | AGGAUGGCGCAGGAACUCA | 1873 | 2007-2025 | UGAGUUCCUGCGCCAUCCU | 1911 | 2007-2025 |
| AD-75918.1 | GGAUGGCGCAGGAACUCAA | 1874 | 2008-2026 | UUGAGUUCCUGCGCCAUCC | 1912 | 2008-2026 |
| AD-75917.1 | GAUGGCGCAGGAACUCAAU | 1875 | 2009-2027 | AUUGAGUUCCUGCGCCAUC | 1913 | 2009-2027 |
| AD-75916.1 | AUGGCGCAGGAACUCAAUA | 1876 | 2010-2028 | UAUUGAGUUCCUGCGCCAU | 1914 | 2010-2028 |
| AD-75915.1 | UGGCGCAGGAACUCAAUAA | 1877 | 2011-2029 | UUAUUGAGUUCCUGCGCCA | 1915 | 2011-2029 |

TABLE 23-continued

F12 Unmodified Sequences

| Duplex Name | Sense Sequence 5' to 3' | SEQ ID NO | Range in SEQ ID NO: 9 | Antisense Sequence 5' to 3' | SEQ ID NO | Range in SEQ ID NO: 9 |
|---|---|---|---|---|---|---|
| AD-75914.1 | GGCGCAGGAACUCAAUAAA | 1878 | 2012-2030 | UUUAUUGAGUUCCUGCGCC | 1916 | 2012-2030 |
| AD-75913.1 | GCGCAGGAACUCAAUAAAA | 1879 | 2013-2031 | UUUUAUUGAGUUCCUGCGC | 1917 | 2013-2031 |
| AD-75912.1 | CGCAGGAACUCAAUAAAGU | 1880 | 2014-2032 | ACUUUAUUGAGUUCCUGCG | 1918 | 2014-2032 |
| AD-70650.2 | GCAGGAACUCAAUAAAGUA | 1881 | 2015-2033 | UACUUUAUUGAGUUCCUGC | 1919 | 2015-2033 |
| AD-75911.1 | CAGGAACUCAAUAAAGUGA | 1882 | 2016-2034 | UCACUUUAUUGAGUUCCUG | 1920 | 2016-2034 |
| AD-75910.1 | AGGAACUCAAUAAAGUGCU | 1883 | 2017-2035 | AGCACUUUAUUGAGUUCCU | 1921 | 2017-2035 |
| AD-75909.1 | GGAACUCAAUAAAGUGCUU | 1884 | 2018-2036 | AAGCACUUUAUUGAGUUCC | 1922 | 2018-2036 |
| AD-75908.1 | GAACUCAAUAAAGUGCUUU | 1885 | 2019-2037 | AAAGCACUUUAUUGAGUUC | 1923 | 2019-2037 |
| AD-75907.1 | AACUCAAUAAAGUGCUUUA | 1886 | 2020-2038 | UAAAGCACUUUAUUGAGUU | 1924 | 2020-2038 |
| AD-75906.1 | ACUCAAUAAAGUGCUUUGA | 1887 | 2021-2039 | UCAAAGCACUUUAUUGAGU | 1925 | 2021-2039 |
| AD-75922.1 | UCAAUAAAGUGCUUUGAAA | 1888 | 2023-2041 | UUUCAAAGCACUUUAUUGA | 1926 | 2023-2041 |
| AD-75923.1 | CAAUAAAGUGCUUUGAAAA | 1889 | 2024-2042 | UUUUCAAAGCACUUUAUUG | 1927 | 2024-2042 |
| AD-70651.2 | AAUAAAGUGCUUUGAAAAU | 1890 | 2025-2043 | AUUUUCAAAGCACUUUAUU | 1928 | 2025-2043 |
| AD-75924.1 | AUAAAGUGCUUUGAAAAUA | 1891 | 2026-2044 | UAUUUUCAAAGCACUUUAU | 1929 | 2026-2044 |
| AD-75925.1 | UAAAGUGCUUUGAAAAUGA | 1892 | 2027-2045 | UCAUUUUCAAAGCACUUUA | 1930 | 2027-2045 |
| AD-75926.1 | AAAGUGCUUUGAAAAUGCU | 1893 | 2028-2046 | AGCAUUUUCAAAGCACUUU | 1931 | 2028-2046 |
| AD-75927.1 | AAGUGCUUUGAAAAUGCUA | 1894 | 2029-2047 | UAGCAUUUUCAAAGCACUU | 1932 | 2029-2047 |
| AD-75928.1 | AGUGCUUUGAAAAUGCUGA | 1895 | 2030-2048 | UCAGCAUUUUCAAAGCACU | 1933 | 2030-2048 |
| AD-75929.1 | GUGCUUUGAAAAUGCUGAA | 1896 | 2031-2049 | UUCAGCAUUUUCAAAGCAC | 1934 | 2031-2049 |
| AD-75930.1 | UGCUUUGAAAAUGCUGAGA | 1897 | 2032-2050 | UCUCAGCAUUUUCAAAGCA | 1935 | 2032-2050 |
| AD-75931.1 | GCUUUGAAAAUGCUGAGAA | 1898 | 2033-2051 | UUCUCAGCAUUUUCAAAGC | 1936 | 2033-2051 |
| AD-75932.1 | CUUUGAAAAUGCUGAGAAA | 1899 | 2034-2052 | UUUCUCAGCAUUUUCAAAG | 1937 | 2034-2052 |
| AD-75933.1 | UUUGAAAAUGCUGAGAAAA | 1900 | 2035-2053 | UUUUCUCAGCAUUUUCAAA | 1938 | 2035-2053 |
| AD-70652.2 | UUGAAAAUGCUGAGAAAAA | 1901 | 2036-2054 | UUUUUCUCAGCAUUUUCAA | 1939 | 2036-2054 |
| AD-75934.1 | UGAAAAUGCUGAGAAAAAA | 1902 | 2037-2055 | UUUUUUCUCAGCAUUUUCA | 1940 | 2037-2055 |
| AD-75935.1 | GAAAAUGCUGAGAAAAAAA | 1903 | 2038-2056 | UUUUUUUCUCAGCAUUUUC | 1941 | 2038-2056 |
| AD-75936.1 | AAAAUGCUGAGAAAAAAAA | 1904 | 2039-2057 | UUUUUUUUCUCAGCAUUUU | 1942 | 2039-2057 |
| AD-75937.1 | AAAUGCUGAGAAAAAAAAA | 1905 | 2040-2058 | UUUUUUUUUCUCAGCAUUU | 1943 | 2040-2058 |
| AD-75938.1 | AAUGCUGAGAAAAAAAAAA | 1906 | 2041-2059 | UUUUUUUUUUCUCAGCAUU | 1944 | 2041-2059 |
| AD-75939.1 | AUGCUGAGAAAAAAAAAAA | 1907 | 2042-2060 | UUUUUUUUUUUCUCAGCAU | 1945 | 2042-2060 |

TABLE 24

F12 Modified Sequences

| Duplex Name | Sense Sequence 5' to 3' | SEQ ID NO | Antisense Sequence 5' to 3' | SEQ ID NO | mRNA target sequence 5' to 3' | SEQ ID NO | mRNA target site in SEQ ID NO: 9 |
|---|---|---|---|---|---|---|---|
| AD-70649 | GCCAGGAUGGCGCAGGAAAdTdT | 1946 | UUUCCUGCGCCAUCCUGGCdTdT | 1984 | GCCAGGAUGGCGCAGGAAC | 2022 | 2004-2022 |
| AD-75921 | CCAGGAUGGCGCAGGAACUdTdT | 1947 | AGUUCCUGCGCCAUCCUGGdTdT | 1985 | CCAGGAUGGCGCAGGAACU | 2023 | 2005-2023 |
| AD-75920 | CAGGAUGGCGCAGGAACUAdTdT | 1948 | UAGUUCCUGCGCCAUCCUGdTdT | 1986 | CAGGAUGGCGCAGGAACUC | 2024 | 2006-2024 |
| AD-75919 | AGGAUGGCGCAGGAACUCAdTdT | 1949 | UGAGUUCCUGCGCCAUCCUdTdT | 1987 | AGGAUGGCGCAGGAACUCA | 2025 | 2007-2025 |
| AD-75918 | GGAUGGCGCAGGAACUCAAdTdT | 1950 | UUGAGUUCCUGCGCCAUCCdTdT | 1988 | GGAUGGCGCAGGAACUCAA | 2026 | 2008-2026 |
| AD-75917 | GAUGGCGCAGGAACUCAAUdTdT | 1951 | AUUGAGUUCCUGCGCCAUCdTdT | 1989 | GAUGGCGCAGGAACUCAAU | 2027 | 2009-2027 |
| AD-75916 | AUGGCGCAGGAACUCAAUAdTdT | 1952 | UAUUGAGUUCCUGCGCCAUdTdT | 1990 | AUGGCGCAGGAACUCAAUA | 2028 | 2010-2028 |
| AD-75915 | UGGCGCAGGAACUCAAUAAdTdT | 1953 | UUAUUGAGUUCCUGCGCCAdTdT | 1991 | UGGCGCAGGAACUCAAUAA | 2029 | 2011-2029 |
| AD-75914 | GGCGCAGGAACUCAAUAAAdTdT | 1954 | UUUAUUGAGUUCCUGCGCCdTdT | 1992 | GGCGCAGGAACUCAAUAAA | 2030 | 2012-2030 |
| AD-75913 | GCGCAGGAACUCAAUAAAAdTdT | 1955 | UUUUAUUGAGUUCCUGCGCdTdT | 1993 | GCGCAGGAACUCAAUAAAG | 2031 | 2013-2031 |
| AD-75912 | CGCAGGAACUCAAUAAAGUdTdT | 1956 | ACUUUAUUGAGUUCCUGCGdTdT | 1994 | CGCAGGAACACAAUAAAGU | 2032 | 2014-2032 |
| AD-70650 | GCAGGAACUCAAUAAAGUAdTdT | 1957 | UACUUUAUUGAGUUCCUGCdTdT | 1995 | GCAGGAACUCAAUAAAGUG | 2033 | 2015-2033 |
| AD-75911 | CAGGAACUCAAUAAAGUGAdTdT | 1958 | UCACUUUAUUGAGUUCCUGdTdT | 1996 | CAGGAACUCAAUAAAGUGC | 2034 | 2016-2034 |
| AD-75910 | AGGAACUCAAUAAAGUGCUdTdT | 1959 | AGCACUUUAUUGAGUUCCUdTdT | 1997 | AGGAACUCAAUAAAGUGCU | 2035 | 2017-2035 |
| AD-75909 | GGAACUCAAUAAAGUGCUUdTdT | 1960 | AAGCACUUUAUUGAGUUCCdTdT | 1998 | GGAACUCAAUAAAGUGCUU | 2036 | 2018-2036 |
| AD-75908 | GAACUCAAUAAAGUGCUUUdTdT | 1961 | AAAGCACUUUAUUGAGUUCdTdT | 1999 | GAACUCAAUAAAGUGCUUU | 2037 | 2019-2037 |
| AD-75907 | AACUCAAUAAAGUGCUUUAdTdT | 1962 | UAAAGCACUUUAUUGAGUUdTdT | 2000 | AACUCAAUAAAGUGCUUUG | 2038 | 2020-2038 |
| AD-75906 | ACUCAAUAAAGUGCUUUGAdTdT | 1963 | UCAAAGCACUUUAUUGAGUdTdT | 2001 | ACUCAAUAAAGUGCUUUGA | 2039 | 2021-2039 |
| AD-75922 | UCAAUAAAGUGCUUUGAAAdTdT | 1964 | UUUCAAAGCACUUUAUUGAdTdT | 2002 | UCAAUAAAGUGCUUUGAAA | 2040 | 2023-2041 |
| AD-75923 | CAAUAAAGUGCUUUGAAAAdTdT | 1965 | UUUUCAAAGCACUUUAUUGdTdT | 2003 | CAAUAAAGUGCUUUGAAAA | 2041 | 2024-2042 |
| AD-70651 | AAUAAAGUGCUUUGAAAAUdTdT | 1966 | AUUUUCAAAGCACUUUAUUdTdT | 2004 | AAUAAAGUGCUUUGAAAAU | 2042 | 2025-2043 |
| AD-75924 | AUAAAGUGCUUUGAAAAUAdTdT | 1967 | UAUUUUCAAAGCACUUUAUdTdT | 2005 | AUAAAGUGCUUUGAAAAUG | 2043 | 2026-2044 |
| AD-75925 | UAAAGUGCUUUGAAAAUGAdTdT | 1968 | UCAUUUUCAAAGCACUUUAdTdT | 2006 | UAAAGUGCUUUGAAAAUGC | 2044 | 2027-2045 |
| AD-75926 | AAAGUGCUUUGAAAAUGCUdTdT | 1969 | AGCAUUUUCAAAGCACUUUdTdT | 2007 | AAAGUGCUUUGAAAAUGCU | 2045 | 2028-2046 |

TABLE 24-continued

F12 Modified Sequences

| Duplex Name | Sense Sequence 5' to 3' | SEQ ID NO | Antisense Sequence 5' to 3' | SEQ ID NO | mRNA target sequence 5' to 3' | SEQ ID NO | mRNA target site in SEQ ID NO: 9 |
|---|---|---|---|---|---|---|---|
| AD-75927 | AAGUGCUUUGAAAAUGCUA dTdT | 1970 | UAGCAUUUUCAAAGCACUU dTdT | 2008 | AAGUGCUUUGAAAAUGC UG | 2046 | 2029-2047 |
| AD-75928 | AGUGCUUUGAAAAUGCUGA dTdT | 1971 | UCAGCAUUUUCAAAGCACU dTdT | 2009 | AGUGCUUUGAAAAUGCU GA | 2047 | 2030-2048 |
| AD-75929 | GUGCUUUGAAAAUGCUGAA dTdT | 1972 | UUCAGCAUUUUCAAAGCAC dTdT | 2010 | GUGCUUUGAAAAUGCUG AG | 2048 | 2031-2049 |
| AD-75930 | UGCUUUGAAAAUGCUGAGA dTdT | 1973 | UCUCAGCAUUUUCAAAGCA dTdT | 2011 | UGCUUUGAAAAUGCUGA GA | 2049 | 2032-2050 |
| AD-75931 | GCUUUGAAAAUGCUGAGAA dTdT | 1974 | UUCUCAGCAUUUUCAAAGC dTdT | 2012 | GCUUUGAAAAUGCUGAG AA | 2050 | 2033-2051 |
| AD-75932 | CUUUGAAAAUGCUGAGAAA dTdT | 1975 | UUUCUCAGCAUUUUCAAAG dTdT | 2013 | CUUUGAAAAUGCUGAGA AA | 2051 | 2034-2052 |
| AD-75933 | UUUGAAAAUGCUGAGAAAA dTdT | 1976 | UUUUCUCAGCAUUUUCAAA dTdT | 2014 | UUUGAAAAUGCUGAGAA AA | 2052 | 2035-2053 |
| AD-70652 | UUGAAAAUGCUGAGAAAAA dTdT | 1977 | UUUUUCUCAGCAUUUUCAA dTdT | 2015 | UUGAAAAUGCUGAGAAA AA | 2053 | 2036-2054 |
| AD-75934 | UGAAAAUGCUGAGAAAAAA dTdT | 1978 | UUUUUUCUCAGCAUUUUCA dTdT | 2016 | UGAAAAUGCUGAGAAAA AA | 2054 | 2037-2055 |
| AD-75935 | GAAAAUGCUGAGAAAAAAA dTdT | 1979 | UUUUUUUCUCAGCAUUUUC dTdT | 2017 | GAAAAUGCUGAGAAAAA AA | 2055 | 2038-2056 |
| AD-75936 | AAAAUGCUGAGAAAAAAAA dTdT | 1980 | UUUUUUUUCUCAGCAUUUU dTdT | 2018 | AAAAUGCUGAGAAAAAA AA | 2056 | 2039-2057 |
| AD-75937 | AAAUGCUGAGAAAAAAAAA dTdT | 1981 | UUUUUUUUUCUCAGCAUUU dTdT | 2019 | AAAUGCUGAGAAAAAAA AA | 2057 | 2040-2058 |
| AD-75938 | AAUGCUGAGAAAAAAAAAA dTdT | 1982 | UUUUUUUUUUCUCAGCAUU dTdT | 2020 | AAUGCUGAGAAAAAAAA AA | 2058 | 2041-2059 |
| AD-75939 | AUGCUGAGAAAAAAAAAAA dTdT | 1983 | UUUUUUUUUUUCUCAGCAU dTdT | 2021 | AUGCUGAGAAAAAAAAA AA | 2059 | 2042-2060 |

TABLE 25

F12 Single Dose Screen in Hep3b Cells

| Duplex ID | 10 nM_Avg | 10 nM_SD | 0.1 nM_AVG | 0.1 nM_SD |
|---|---|---|---|---|
| AD-70649.2 | 28.65 | 6.26 | 41.38 | 9.60 |
| AD-75921.1 | 29.32 | 7.31 | 41.14 | 10.86 |
| AD-75920.1 | 30.91 | 5.90 | 45.92 | 15.18 |
| AD-75919.1 | 32.12 | 14.45 | 66.98 | 17.31 |
| AD-75918.1 | 28.51 | 14.34 | 57.71 | 21.51 |
| AD-75917.1 | 22.80 | 1.02 | 33.45 | 5.13 |
| AD-75916.1 | 27.48 | 7.88 | 34.62 | 6.73 |
| AD-75915.1 | 50.58 | 28.39 | 56.95 | 39.88 |
| AD-75914.1 | 28.22 | 5.74 | 54.70 | 9.80 |
| AD-75913.1 | 38.35 | 11.58 | 32.08 | 9.74 |
| AD-75912.1 | 27.06 | 9.92 | 39.41 | 14.48 |
| AD-70650.2 | 31.86 | 12.64 | 40.42 | 11.08 |
| AD-75911.1 | 28.50 | 5.83 | 53.54 | 9.61 |
| AD-75910.1 | 34.12 | 6.44 | 47.93 | 22.85 |
| AD-75909.1 | 35.13 | 13.76 | 51.88 | 42.23 |
| AD-75908.1 | 38.17 | 7.67 | 66.18 | 59.34 |
| AD-75907.1 | 40.80 | 20.27 | 62.36 | 20.96 |
| AD-75906.1 | 49.29 | 8.64 | 58.20 | 26.56 |
| AD-75922.1 | 25.51 | 3.58 | 45.53 | 20.00 |
| AD-75923.1 | 49.08 | 13.60 | 49.27 | 11.54 |
| AD-70651.2 | 55.60 | 32.34 | 94.24 | 39.01 |
| AD-75924.1 | 46.27 | 14.11 | 53.33 | 11.68 |
| AD-75925.1 | 37.21 | 8.81 | 46.28 | 17.48 |
| AD-75926.1 | 27.13 | 6.82 | 39.29 | 8.19 |
| AD-75927.1 | 47.80 | 14.67 | 62.71 | 21.77 |
| AD-75928.1 | 34.40 | 6.27 | 70.89 | 29.90 |
| AD-75929.1 | 43.65 | 16.80 | 54.91 | 4.67 |
| AD-75930.1 | 72.67 | 33.09 | 81.86 | 17.63 |
| AD-75931.1 | 85.60 | 17.39 | 88.98 | 12.61 |
| AD-75932.1 | 46.69 | 3.04 | 68.57 | 12.35 |
| AD-75933.1 | 75.04 | 4.59 | 97.52 | 8.55 |
| AD-70652.2 | 104.50 | 12.08 | 84.12 | 4.74 |
| AD-75934.1 | 83.25 | 19.97 | 82.77 | 10.51 |
| AD-75935.1 | 65.87 | 3.46 | 84.47 | 11.66 |
| AD-75936.1 | 97.74 | 3.66 | 93.48 | 10.33 |
| AD-75937.1 | 112.45 | 30.62 | 98.91 | 29.75 |
| AD-75938.1 | 125.12 | 33.83 | 110.47 | 33.87 |
| AD-75939.1 | 112.95 | 24.79 | 93.19 | 18.21 |

Example 15. Evaluation of 5'-End Modifications of F12 siRNA Duplexes

Additional iRNA agents targeting F12 comprising a nucleotide comprising a 5'-phosphate mimic, i.e., a vinyl phosphate, were designed, synthesized, and screened for in vitro efficacy, as described above. Agents comprising the same unmodified and modified nucleotide sequences of these agents but without the 5'-antisense strand vinyl phosphate modification were also designed, synthesized and screened, as described above. A detailed list of all of these additional unmodified F12 sense and antisense strand sequences is shown in Table 26. A detailed list of all of these additional modified F12 sense and antisense strand sequences is shown in Table 27. Table 28 provides the results of a single dose screen in primary mouse hepatocytes cells transfected with the indicated F12 dsRNA agents.

Figure 13:
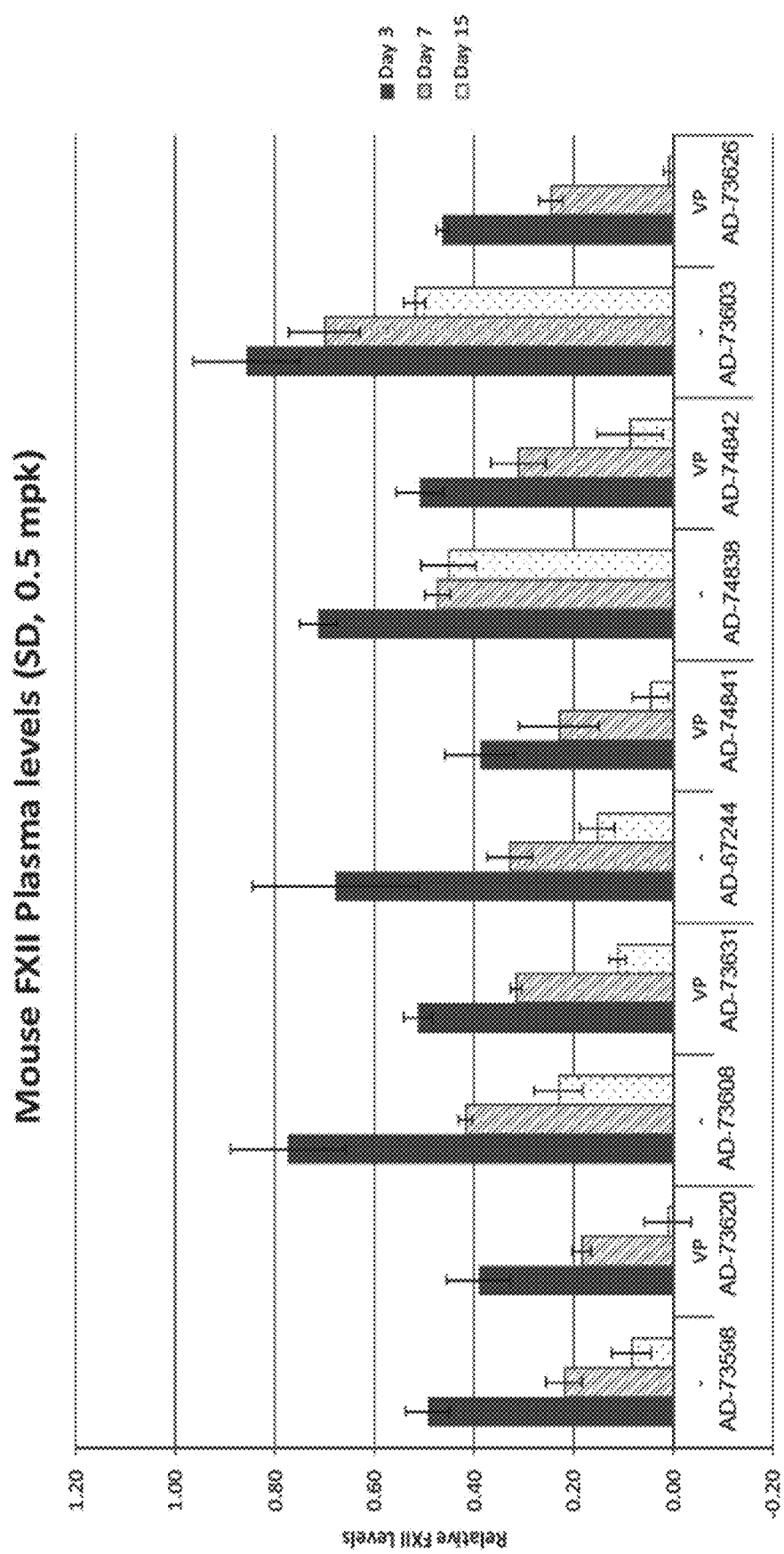
FIG. 13 is a graph depicting the effect of 5'-end modifications on the in vivo efficacy of the indicated agents.

The in vivo efficacy of a subset of these compounds was also assessed by subcutaneously administering wild-type mice a single 0.5 mg/kg dose of an agent and determining the level of F12 protein in the plasma of the animals at days 3, 7, and 15 post-dose. FIG. 13 depicts the results of these assays and demonstrates that the addition of a 5'vinyl phosphate to the antisense strands has a moderate effect on the in vivo efficacy of the indicated agents.

TABLE 26

F12 Unmodified F12 Sequences

| Duplex Name | Sense Sequence 5' to 3' | SEQ ID NO | Antisense Sequence 5' to 3' | SEQ ID NO | Range in SEQ ID NO: 9 |
|---|---|---|---|---|---|
| AD-73610 | GGAGCCCAAGAAAGUGAAAGA | 2060 | UCUUUCACUUUCUUGGGCUCCAA | 2105 | 299-321 |
| AD-73633 | GGAGCCCAAGAAAGUGAAAGA | 2061 | UCUUUCACUUUCUUGGGCUCCAA | 2106 | 299-321 |
| AD-73604 | GAGCCCAAGAAAGUGAAAGAA | 2062 | UUCUUUCACUUUCUUGGGCUCCA | 2107 | 300-322 |
| AD-73627 | GAGCCCAAGAAAGUGAAAGAA | 2063 | UUCUUUCACUUUCUUGGGCUCCA | 2108 | 300-322 |
| AD-73595 | GCCCAAGAAAGUGAAAGACCA | 2064 | UGGUCUUUCACUUUCUUGGGCUC | 2109 | 302-324 |
| AD-73617 | GCCCAAGAAAGUGAAAGACCA | 2065 | UGGUCUUUCACUUUCUUGGGCUC | 2110 | 302-324 |
| AD-73606 | CCCAAGAAAGUGAAAGACCAA | 2066 | UUGGUCUUUCACUUUCUUGGGCU | 2111 | 303-325 |
| AD-73629 | CCCAAGAAAGUGAAAGACCAA | 2067 | UUGGUCUUUCACUUUCUUGGGCU | 2112 | 303-325 |
| AD-73609 | AAAGAGAAAUGCUUUGAGCCA | 2068 | UGGCUCAAAGCAUUUCUCUUUCU | 2113 | 426-448 |
| AD-73632 | AAAGAGAAAUGCUUUGAGCCA | 2069 | UGGCUCAAAGCAUUUCUCUUUCU | 2114 | 426-448 |
| AD-73599 | AAGAGAAAUGCUUUGAGCCUA | 2070 | UAGGCUCAAAGCAUUUCUCUUUC | 2115 | 427-449 |
| AD-73621 | AAGAGAAAUGCUUUGAGCCUA | 2071 | UAGGCUCAAAGCAUUUCUCUUUC | 2116 | 427-449 |
| AD-73597 | AGAGAAAUGCUUUGAGCCUCA | 2072 | UGAGGCUCAAAGCAUUUCUCUUU | 2117 | 428-450 |
| AD-73619 | AGAGAAAUGCUUUGAGCCUCA | 2073 | UGAGGCUCAAAGCAUUUCUCUUU | 2118 | 428-450 |
| AD-73596 | GAGAAAUGCUUUGAGCCUCAA | 2074 | UUGAGGCUCAAAGCAUUUCUCUU | 2119 | 429-451 |
| AD-73618 | GAGAAAUGCUUUGAGCCUCAA | 2075 | UUGAGGCUCAAAGCAUUUCUCUU | 2120 | 429-451 |
| AD-73614 | AGAAAUGCUUUGAGCCUCAGA | 2076 | UCUGAGGCUCAAAGCAUUUCUCU | 2121 | 430-452 |
| AD-73637 | AGAAAUGCUUUGAGCCUCAGA | 2077 | UCUGAGGCUCAAAGCAUUUCUCU | 2122 | 430-452 |
| AD-73611 | AAAUGCUUUGAGCCUCAGCUA | 2078 | UAGCUGAGGCUCAAAGCAUUUCU | 2123 | 432-454 |
| AD-73634 | AAAUGCUUUGAGCCUCAGCUA | 2079 | UAGCUGAGGCUCAAAGCAUUUCU | 2124 | 432-454 |
| AD-73605 | AUGCUUUGAGCCUCAGCUUCA | 2080 | UGAAGCUGAGGCUCAAAGCAUUU | 2125 | 434-456 |
| AD-73628 | AUGCUUUGAGCCUCAGCUUCA | 2081 | UGAAGCUGAGGCUCAAAGCAUUU | 2126 | 434-456 |
| AD-73601 | UGCUUUGAGCCUCAGCUUCUA | 2082 | UAGAAGCUGAGGCUCAAAGCAUU | 2127 | 435-457 |
| AD-73624 | UGCUUUGAGCCUCAGCUUCUA | 2083 | UAGAAGCUGAGGCUCAAAGCAUU | 2128 | 435-457 |
| AD-73613 | GCUUUGAGCCUCAGCUUCUCA | 2084 | UGAGAAGCUGAGGCUCAAAGCAU | 2129 | 436-458 |
| AD-73636 | GCUUUGAGCCUCAGCUUCUCA | 2085 | UGAGAAGCUGAGGCUCAAAGCAU | 2130 | 436-458 |
| AD-73616 | ACUCCACCUUCCUGCAGGAGA | 2086 | UCUCCUGCAGGAAGGUGGAGUAU | 2131 | 1522-1544 |
| AD-73639 | ACUCCACCUUCCUGCAGGAGA | 2087 | UCUCCUGCAGGAAGGUGGAGUAU | 2132 | 1522-1544 |
| AD-73603 | CACAGAAACUCAAUAAAGUGA | 2088 | UCACUUUAUUGAGUUUCUGUGCC | 2133 | 1927-1949 |

TABLE 26-continued

F12 Unmodified F12 Sequences

| Duplex Name | Sense Sequence 5' to 3' | SEQ ID NO | Antisense Sequence 5' to 3' | SEQ ID NO | Range in SEQ ID NO: 9 |
|---|---|---|---|---|---|
| AD-73626 | CACAGAAACUCAAUAAAGUGA | 2089 | UCACUUUAUUGAGUUUCUGUGCC | 2134 | 1927-1949 |
| AD-73607 | ACAGAAACUCAAUAAAGUGCA | 2090 | UGCACUUUAUUGAGUUUCUGUGC | 2135 | 1928-1950 |
| AD-73630 | ACAGAAACUCAAUAAAGUGCA | 2091 | UGCACUUUAUUGAGUUUCUGUGC | 2136 | 1928-1950 |
| AD-73600 | CAGAAACUCAAUAAAGUGCUA | 2092 | UAGCACUUUAUUGAGUUUCUGUG | 2137 | 1929-1951 |
| AD-73622 | CAGAAACUCAAUAAAGUGCUA | 2093 | UAGCACUUUAUUGAGUUUCUGUG | 2138 | 1929-1951 |
| AD-73615 | AGAAACUCAAUAAAGUGCUUA | 2094 | UAAGCACUUUAUUGAGUUUCUGU | 2139 | 1930-1952 |
| AD-73638 | AGAAACUCAAUAAAGUGCUUA | 2095 | UAAGCACUUUAUUGAGUUUCUGU | 2140 | 1930-1952 |
| AD-73598 | GAAACUCAAUAAAGUGCUUUA | 2096 | UAAAGCACUUUAUUGAGUUUCUG | 2141 | 1931-1953 |
| AD-73620 | GAAACUCAAUAAAGUGCUUUA | 2097 | UAAAGCACUUUAUUGAGUUUCUG | 2142 | 1931-1953 |
| AD-73602 | AAACUCAAUAAAGUGCUUUGA | 2098 | UCAAAGCACUUUAUUGAGUUUCU | 2143 | 1932-1954 |
| AD-73625 | AAACUCAAUAAAGUGCUUUGA | 2099 | UCAAAGCACUUUAUUGAGUUUCU | 2144 | 1932-1954 |
| AD-73608 | ACUCAAUAAAGUGCUUUGAAA | 2100 | UUUCAAAGCACUUUAUUGAGUUU | 2145 | 1934-1956 |
| AD-73631 | ACUCAAUAAAGUGCUUUGAAA | 2101 | UUUCAAAGCACUUUAUUGAGUUU | 2146 | 1934-1956 |
| AD-73612 | UCAAUAAAGUGCUUUGAAAAA | 2102 | UUUUUCAAAGCACUUUAUUGAGU | 2147 | 1936-1958 |
| AD-73635 | UCAAUAAAGUGCUUUGAAAAA | 2103 | UUUUUCAAAGCACUUUAUUGAGU | 2148 | 1936-1958 |
| AD-73623 | AACUCAAUAAAGUGCUUUGAA | 2104 | UUCAAAGCACUUUAUUGAGUUUC | 2149 | 1933-1955 |
| AD-74838 | AAUAAAGUGCUUUGAAAACGA | 2333 | UCGUUUUCAAAGCACUUUAUUGA | 2335 | 1938-1960 |
| AD-74842 | AAUAAAGUGCUUUGAAAACGA | 2334 | UCGUUUUCAAAGCACUUUAUUGA | 2336 | 1938-1960 |

TABLE 27

Modified F12 Sequences

| Duplex Name | Sense Sequence 5' to 3' | SEQ ID NO | Antisense Sequence 5' to 3' | SEQ ID NO | mRNA target sequence | SEQ ID NO |
|---|---|---|---|---|---|---|
| AD-73610 | gsgsagccCfaAfGfAfaaguga agaL96 | 2150 | usCfsuuuCfaCfUfuucuUfg Gfgcuccsasa | 2195 | UUGGAGCCCAAGAAAGUGAA AGA | 2240 |
| AD-73633 | gsgsagccCfaAfGfAfaaguga agaL96 | 2151 | PusCfsuuuCfaCfUfuucuUf gGfgcuccsasa | 2196 | UUGGAGCCCAAGAAAGUGAA AGA | 2241 |
| AD-73604 | gsasgcccAfaGfAfAfagugaa agaaL96 | 2152 | usUfscuuUfcAfCfuuucUfu Gfggcucscsa | 2197 | UGGAGCCCAAGAAAGUGAAA GAC | 2242 |
| AD-73627 | gsasgcccAfaGfAfAfagugaa agaaL96 | 2153 | PusUfscuuUfcAfCfuuucUf uGfggcucscsa | 2198 | UGGAGCCCAAGAAAGUGAAA GAC | 2243 |
| AD-73595 | gscsccaaGfaAfAfGfugaaag accaL96 | 2154 | usGfsgucUfuUfCfacuuUfc Ufugggcsusc | 2199 | GAGCCCAAGAAAGUGAAAGA CCA | 2244 |
| AD-73617 | gscsccaaGfaAfAfGfugaaag accaL96 | 2155 | PusGfsgucUfuUfCfacuuUf cUfugggcsusc | 2200 | GAGCCCAAGAAAGUGAAAGA CCA | 2245 |
| AD-73606 | cscscaagAfaAfGfUfgaaaga ccaaL96 | 2156 | usUfsgguCfuUfUfcacuUfu Cfuugggscsu | 2201 | AGCCCAAGAAAGUGAAAGAC CAU | 2246 |
| AD-73629 | cscscaagAfaAfGfUfgaaaga ccaaL96 | 2157 | PusUfsgguCfuUfUfcacuUf uCfuugggscsu | 2202 | AGCCCAAGAAAGUGAAAGAC CAU | 2247 |
| AD-73609 | asasagagAfaAfUfGfcuuuga gccaL96 | 2158 | usGfsgcuCfaAfAfgcauUfu Cfucuuuscsu | 2203 | AGAAAGAGAAAUGCUUUGAG CCU | 2248 |
| AD-73632 | asasagagAfaAfUfGfcuuuga gccaL96 | 2159 | PusGfsgcuCfaAfAfgcauUf uCfucuuuscsu | 2204 | AGAAAGAGAAAUGCUUUGAG CCU | 2249 |

TABLE 27-continued

Modified F12 Sequences

| Duplex Name | Sense Sequence 5' to 3' | SEQ ID NO | Antisense Sequence 5' to 3' | SEQ ID NO | mRNA target sequence | SEQ ID NO |
|---|---|---|---|---|---|---|
| AD-73599 | asasgagaAfaUfGfCfuuugagccuaL96 | 2160 | usAfsggcUfcAfAfagcaUfuUfcucuususc | 2205 | GAAAGAGAAAUGCUUUGAGCCUC | 2250 |
| AD-73621 | asasgagaAfaUfGfCfuuugagccuaL96 | 2161 | PusAfsggcUfcAfAfagcaUfuUfcucuususc | 2206 | GAAAGAGAAAUGCUUUGAGCCUC | 2251 |
| AD-73597 | asgsagaaAfuGfCfUfuugagccucaL96 | 2162 | usGfsaggCfuCfAfaagcAfuUfucucususu | 2207 | AAAGAGAAAUGCUUUGAGCCUCA | 2252 |
| AD-73619 | asgsagaaAfuGfCfUfuugagccucaL96 | 2163 | PusGfsaggCfuCfAfaagcAfuUfucucususu | 2208 | AAAGAGAAAUGCUUUGAGCCUCA | 2253 |
| AD-73596 | gsasgaaaUfgCfUfUfugagccucaaL96 | 2164 | usUfsgagGfcUfCfaaagCfaUfuucucsusu | 2209 | AAGAGAAAUGCUUUGAGCCUCAG | 2254 |
| AD-73618 | gsasgaaaUfgCfUfUfugagccucaaL96 | 2165 | PusUfsgagGfcUfCfaaagCfaUfuucucsusu | 2210 | AAGAGAAAUGCUUUGAGCCUCAG | 2255 |
| AD-73614 | asgsaaauGfcUfUfUfgagccucagaL96 | 2166 | usCfsugaGfcUfCfaaaGfcAfuuucuscsu | 2211 | AGAGAAAUGCUUUGAGCCUCAGC | 2256 |
| AD-73637 | asgsaaauGfcUfUfUfgagccucagaL96 | 2167 | PusCfsugaGfgCfUfCfcaaaGfcAfuuucuscsu | 2212 | AGAGAAAUGCUUUGAGCCUCAGC | 2257 |
| AD-73611 | asasaugcUfuUfGfAfgccucagcuaL96 | 2168 | usAfsgcUfgaGfGfcucaAfaGfcauuuscsu | 2213 | AGAAAUGCUUUGAGCCUCAGCUU | 2258 |
| AD-73634 | asasaugcUfuUfGfAfgccucagcuaL96 | 2169 | PusAfsgcuGfaGfGfcucaAfaGfcauuuscsu | 2214 | AGAAAUGCUUUGAGCCUCAGCUU | 2259 |
| AD-73605 | asusgcuuUfgAfGfCfcucagcuucaL96 | 2170 | usGfsaagCfuGfAfggcuCfaAfagcasusu | 2215 | AAAUGCUUUGAGCCUCAGCUUCU | 2260 |
| AD-73628 | asusgcuuUfgAfGfCfcucagcuucaL96 | 2171 | PusGfsaagCfuGfAfggcuCfaAfagcasusu | 2216 | AAAUGCUUUGAGCCUCAGCUUCU | 2261 |
| AD-73601 | usgscuuuGfaGfCfCfucagcuucuaL96 | 2172 | usAfsgaaGfcUfGfaggcUfcAfaagcasusu | 2217 | AAUGCUUUGAGCCUCAGCUUCUC | 2262 |
| AD-73624 | usgscuuuGfaGfCfCfucagcuucuaL96 | 2173 | PusAfsgaaGfcUfGfaggcUfcAfaagcasusu | 2218 | AAUGCUUUGAGCCUCAGCUUCUC | 2263 |
| AD-73613 | gscsuuugAfgCfCfUfcagcuucucaL96 | 2174 | usGfsagaAfgCfUfgaggCfuCfaaagcsasu | 2219 | AUGCUUUGAGCCUCAGCUUCUCA | 2264 |
| AD-73636 | gscsuuugAfgCfCfUfcagcuucucaL96 | 2175 | PusGfsagaAfgCfUfgaggCfuCfaaagcsasu | 2220 | AUGCUUUGAGCCUCAGCUUCUCA | 2265 |
| AD-73616 | ascsuccaCfcUfUfCfcugcaggagaL96 | 2176 | usCfsuccUfgCfAfggaaGfgUfggagusasu | 2221 | AUACUCCACCUUCCUGCAGGAGG | 2266 |
| AD-73639 | ascsuccaCfcUfUfCfcugcaggagaL96 | 2177 | PusCfsuccUfgCfAfggaaGfgUfggagusasu | 2222 | AUACUCCACCUUCCUGCAGGAGG | 2267 |
| AD-73603 | csascagaAfaCfUfCfaauaaagugaL96 | 2178 | usCfsacuUfuAfUfugagUfuUfcugugscsc | 2223 | GGCACAGAAACUCAAUAAAGUGC | 2268 |
| AD-73626 | csascagaAfaCfUfCfaauaaagugaL96 | 2179 | PusCfsacuUfuAfUfugagUfuUfcugugscsc | 2224 | GGCACAGAAACUCAAUAAAGUGC | 2269 |
| AD-73607 | ascsagaaAfcUfCfAfauaaagugcaL96 | 2180 | usGfscacUfuUfAfuugaGfuUfucugusgsc | 2225 | GCACAGAAACUCAAUAAAGUGCU | 2270 |
| AD-73630 | ascsagaaAfcUfCfAfauaaagugcaL96 | 2181 | PusGfscacUfuUfAfuugaGfuUfucugusgsc | 2226 | GCACAGAAACUCAAUAAAGUGCU | 2271 |
| AD-73600 | csasgaaaCfuCfAfAfuaaagugcuaL96 | 2182 | usAfsgcaCfuUfUfauugAfgUfuucugsusg | 2227 | CACAGAAACUCAAUAAAGUGCUU | 2272 |
| AD-73622 | csasgaaaCfuCfAfAfuaaagugcuaL96 | 2183 | PusAfsgcaCfuUfUfauugAfgUfuucugsusg | 2228 | CACAGAAACUCAAUAAAGUGCUU | 2273 |
| AD-73615 | asgsaaacUfcAfAfUfaaagugcuuaL96 | 2184 | usAfsagcAfcUfUfuauuGfaGfuuucusgsu | 2229 | ACAGAAACUCAAUAAAGUGCUUU | 2274 |

TABLE 27-continued

Modified F12 Sequences

| Duplex Name | Sense Sequence 5' to 3' | SEQ ID NO | Antisense Sequence 5' to 3' | SEQ ID NO | mRNA target sequence | SEQ ID NO |
|---|---|---|---|---|---|---|
| AD-73638 | asgsaaacUfcAfAfUfaaagugcuuaL96 | 2185 | PusAfsagcAfcUfUfuauuGfaGfuuucusgsu | 2230 | ACAGAAACUCAAUAAAGUGCUUU | 2275 |
| AD-73598 | gsasaacuCfaAfUfAfaagugcuuuaL96 | 2186 | usAfsaagCfaCfUfuuauUfgAfguuucsusg | 2231 | CAGAAACUCAAUAAAGUGCUUUG | 2276 |
| AD-73620 | gsasaacuCfaAfUfAfaagugcuuuaL96 | 2187 | PusAfsaagCfaCfUfuuauUfgAfguuucsusg | 2232 | CAGAAACUCAAUAAAGUGCUUUG | 2277 |
| AD-73602 | asasacucAfaUfAfAfagugcuuugaL96 | 2188 | usCfsaaaGfcAfCfuuuaUfuGfaguuuscsu | 2233 | AGAAACUCAAUAAAGUGCUUUGA | 2278 |
| AD-73625 | asasacucAfaUfAfAfagugcuuugaL96 | 2189 | PusCfsaaaGfcAfCfuuuaUfuGfaguuuscsu | 2234 | AGAAACUCAAUAAAGUGCUUUGA | 2279 |
| AD-73608 | ascsucaaUfaAfAfGfugcuuugaaaL96 | 2190 | usUfsucaAfaGfCfacuuUfaUfugagususu | 2235 | AAACUCAAUAAAGUGCUUUGAAA | 2280 |
| AD-73631 | ascsucaaUfaAfAfGfugcuuugaaaL96 | 2191 | PusUfsucaAfaGfCfacuuUfaUfugagususu | 2236 | AAACUCAAUAAAGUGCUUUGAAA | 2281 |
| AD-73612 | uscsaauaAfaGfUfGfcuuugaaaaL96 | 2192 | usUfsuuuCfaAfAfgcacUfuUfauugasgsu | 2237 | ACUCAAUAAAGUGCUUUGAAAAC | 2282 |
| AD-73635 | uscsaauaAfaGfUfGfcuuugaaaaL96 | 2193 | PusUfsuuuCfaAfAfgcacUfuUfauugasgsu | 2238 | ACUCAAUAAAGUGCUUUGAAAAC | 2283 |
| AD-73623 | asascucaAfuAfAfAfgugcuuugaaL96 | 2194 | PusUfscaaAfgCfAfcuuuAfuUfgaguususc | 2239 | GAAACUCAAUAAAGUGCUUUGAA | 2284 |
| AD-74838 | asasuaaaGfuGfCfUfuugaaaacgaL96 | 2337 | usCfsguuUfuCfAfaagcAfcUfuuauusgsa | 2339 | UCAAUAAAGUGCUUUGAAAACGA | 2341 |
| AD-74842 | asasuaaaGfuGfCfUfuugaaaacgaL96 | 2338 | PusCfsguuUfuCfAfaagcAfcUfuuauusgsa | 2340 | UCAAUAAAGUGCUUUGAAAACGA | 2342 |

TABLE 28

F12 Single Dose Screen in Primary Mouse Hepatocytes

| | Activity | | | |
|---|---|---|---|---|
| | 10 nM | | 0.1 nM* | |
| Duplex ID | Avg | SD | Avg | SD |
| AD-67244 | 7.5 | 2.3 | 69.5 | 4.6 |
| AD-73610 | 46.8 | 14.1 | 104.7 | 10.1 |
| AD-73633 | 18.0 | 6.8 | 69.2 | 13.3 |
| AD-73604 | 21.0 | 6.3 | 100.3 | 10.0 |
| AD-73627 | 10.5 | 3.2 | 55.5 | 5.7 |
| AD-73595 | 29.0 | 7.6 | 96.1 | 4.8 |
| AD-73617 | 12.4 | 4.9 | 66.1 | 10.5 |
| AD-73606 | 11.8 | 3.6 | 93.2 | 4.1 |
| AD-73629 | 14.9 | 4.6 | 57.8 | 6.4 |
| AD-73609 | 35.2 | 4.7 | 89.6 | 5.0 |
| AD-73632 | 3.3 | 0.6 | 46.5 | 8.0 |
| AD-73599 | 11.7 | 2.2 | 84.4 | 10.9 |
| AD-73621 | 5.9 | 1.7 | 34.8 | 4.4 |
| AD-73597 | 9.4 | 1.8 | 60.6 | 3.0 |
| AD-73619 | 5.0 | 1.7 | 21.0 | 7.4 |
| AD-73596 | 7.3 | 3.1 | 53.2 | 10.9 |
| AD-73618 | 4.6 | 2.4 | 29.4 | 8.2 |
| AD-73614 | 24.0 | 8.8 | 96.0 | 4.8 |
| AD-73637 | 7.1 | 2.2 | 47.3 | 6.9 |
| AD-73611 | 17.3 | 3.8 | 92.5 | 4.0 |
| AD-73634 | 7.1 | 3.5 | 54.5 | 12.5 |
| AD-73605 | 10.2 | 2.1 | 88.7 | 6.0 |
| AD-73628 | 5.7 | 0.4 | 23.5 | 8.1 |
| AD-73601 | 6.4 | 2.4 | 67.4 | 9.9 |
| AD-73624 | 3.0 | 0.5 | 28.0 | 5.9 |
| AD-73613 | 16.4 | 5.3 | 92.6 | 8.8 |
| AD-73636 | 4.8 | 1.5 | 22.5 | 7.2 |
| AD-73616 | 99.7 | 8.0 | 97.3 | 3.2 |
| AD-73639 | 35.5 | 4.8 | 100.3 | 6.7 |
| AD-73603 | 12.8 | 5.0 | 87.7 | 7.2 |
| AD-73626 | 2.2 | 0.8 | 19.8 | 4.3 |
| AD-73607 | 17.4 | 5.6 | 90.0 | 6.4 |
| AD-73630 | 3.9 | 1.2 | 25.0 | 7.3 |
| AD-73600 | 2.7 | 1.5 | 24.9 | 4.9 |
| AD-73622 | 1.5 | 0.2 | 16.2 | 2.3 |
| AD-73615 | 7.6 | 3.6 | 51.9 | 4.8 |
| AD-73638 | 3.7 | 1.5 | 17.6 | 5.6 |
| AD-73598 | 2.0 | 0.5 | 18.7 | 7.5 |
| AD-73620 | 2.0 | 0.3 | 9.5 | 3.4 |
| AD-73602 | 4.4 | 1.9 | 48.7 | 8.4 |
| AD-73625 | 3.3 | 1.4 | 9.8 | 2.0 |
| AD-73608 | 5.5 | 1.3 | 65.4 | 10.7 |
| AD-73631 | 2.1 | 0.4 | 11.1 | 1.9 |
| AD-73612 | 5.4 | 1.4 | 49.1 | 7.3 |
| AD-73635 | 3.5 | 0.7 | 13.0 | 2.5 |
| AD-73623 | 2.5 | 0.4 | 7.2 | 1.2 |

EQUIVALENTS

Those skilled in the art will recognize, or be able to ascertain using no more than routine experimentation, many equivalents to the specific embodiments and methods described herein. Such equivalents are intended to be encompassed by the scope of the following claims.

SEQUENCE LISTING (2344 sequences)

SEQ ID NO: 1 - DNA, 2252 bp, Homo sapiens
  source 1..2252: mol_type = genomic DNA
agaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccagtaacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctctactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaagggagattcaggtggtcccttagtttgcaaacacaatggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaaaacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatcaaaaaa

SEQ ID NO: 2 - DNA, 2252 bp, Homo sapiens
  source 1..2252: mol_type = genomic DNA
ttttttgatctttcaccattttatttcacaacacacagtcatggagatctcagttgcgacctcgcattgtcagcccctggttacggcgtgctgaaagcgggcttcagccagacattgtcctcagcagctctgagtgcactgtgtttttcgtccttaggatgcaaagaagatgccactctccatgctttgcagatgaggaccccccaggctcagaatttgacttgaactcaggttgtaaaaattgcctagactctggactgcttctcatgctggtgactgcatctgagcttttccatcactgctctgtgttttctctaaaatccagtccatgtactcagcgactttggtgtagacaccaggttgctccctgcgggcacagccttcaccccagctggtgatgcccaccaaacgccacattccattgtgtttgcaaactaagggaccacctgaatctcccttacaagcatcttttcccccttctttatagccagcacagaccatccgttgggttattttataatcttgatatcttttctggcattcttcatttgttaccaaaggaatatttaccttttgtagaatattttggatttcacctttctccttcgagaagccccatccggttacccaacagttggtataaattgtgcttgtgtcacctttggaaggtaggcatattggtttttggaattcagtgtaattcaaaggagcctggagttttatcaaggcgatatcatgattcccttctgagactttatagttttggtgaataataatctcttttatttgtgagaaaggtgtatcttttgtaatgtctgacagatttaaaatgccactatagatgcgccaaacatcctgcaggggaagcccatcaaagcagtgggcagcagtgaggacccactggtgtcctatgagtgaccctccacacaggtgcctctgagctgtcagcttcacctgcaggctcacctgccagggccactctccccaagaagagtttgttcctccaacaatgcgtgtgcttgtttttgttgtgcagacagagttgtccccagtgttacacaatctcaaagagtaaccagagctcccttgtgtcccatacgcaatcctagttggagaaccatccatagataatcttaagaaacacttacacttctcttccttacagtcttctgggagtaaagaataagtgaaaaactgacagcgaatcatctttgtgcaagtctcttggcaaacattcactcctttaacaaaagtcacattcaattcttctcctccaaagtcaactcccgggtaaattttagaatggcagggttcaggtaaagttcttttgcaggttaaaaggctatatccagatatggtgttttcttgaggagtagaggaacttggtgtgccactttcagatgttttaagaagacaaacatttctttgtgactcgattttccatacatttgtatagaatgtaaagaagaggcagttggggtgataggtgcagatggtccgacacacaaaagcatctggagtgagaaccctggcaacatccacatctgagaacgcaagatgctggaagatgttcatgtggcaaccaatttctgaaagggcacagggcttcagtgagaatccagattccacgttactcagcacctttatagcggtaggtgttcctccgggactgtactttaataggcaattgttccggtactctgccttgtgaaatgtttgcgtggcatatgaaaaaaactggcagcgaatgttactggtgcaccttttttggcattcttcaacactgctaaccttagacacattaaaattgactcctctcatatcaactcctttataaatgtctcgatggcaagcacttatttgatgaccacattgcttcaaggaatgtccagaaactgcacctgttcgatgtacttttggcagggttcctgtaacactatctttcaagaagcaaccaaaccttttctccatgtcattgattgaacttgctggaagaaaactgaatagcaaacaccttgggtggaatgtgcacctcatctggcagtattgggcatttggggtgtacatggaagctacatccccacctctgaagaaggcgttttcatagagttgagtcagacatccacaggaaactgtagcaaacaaggaaatgaaataagttgcttgcttgaataaaatcattctgaaaacacaattgcttcttggaggtgagtctcttgtcacttaaaaatgaacggtcttcaagctgttct

SEQ ID NO: 3 - DNA, 2472 bp, Mus musculus
  source 1..2472: mol_type = genomic DNA
agaccgccctcggtgccatattcagagggcttgaagaccatcttcatgtgaagactccctctcctccagaaccacaacgtgaccatccttccaggatgattttattcaaccgagtgggttattttgtttccttgtttgctaccgtctcctgtgggtgtatgactcaactgtataaaaataccttcttcagaggtggggatctagctgccatctacaccccagatgcccagtactgtcagaagatgtgcacttttcaccccaggtgcctgctgttcagctttctcgccgtgactccacccaaagagacaaataaacggtttggttgcttcatgaaagagagcattacagggactttgccaagaatacaccggacaggggccatttctggtcattctttaaagcagtgtggccatcaaataagtgcttgccaccgagacatatacaaaggacttgatatgagagggtccaactttaatatctctaagaccgacaatattgaagaatgccagaaactgtgcacaaataattttcactgccaatttttcacatatgctacaagtgcattttacagaccagagtaccggaagaagtgcctgctgaagcacagtgcaagcggaacacccaccagcataaagtcagcggacaacctggtgtctggattctcactgaagtcctgtgcgctttcggagataggttgccccatggatattttccagcactctgcctttgcagacctgaatgtaagccaggtcatcacccccgatgcctttgtgtgtcgcaccatctgcaccttccatcccaactgccttttcttcacgttctacacgaatgaatgggagacagaatcacagagaaatgtttgttttcttaagacgtctaaaagtggaagaccaagtccccctattcctcaagaaaacgctatatctggatatagtctcctcacctgcagaaaaactcgccctgaaccctgccattccaaaatttactctggagttgactttgaaggggaagaactgaatgtgaccttcgtgcaaggagcagatgtctgccaagagacttgtacaaagacaatccgctgccagttttttatttactccttactcccccaagactgcaaggaggaggggtgtaaatgttccttaaggttatccacagatggctccccaactaggatcacctatggcatgcaggggagctccggttattctctgagattgtgtaaacttgtggacagccctgactgtacaacaaaaataaatgcacgtattgtgggaggaacaaacgcttctttaggggagtggccatggcaggtcagcctgcaagtgaagctggtatctcagacccatttgtgtggagggtccatcattggtcgccaatgggtactgacagctgcccattgctttgatggaattccctatccagatgtgtggcgtatatatggcggaattcttagtctgtccgagattacgaaagaaacgccttcctcgagaataaaggagcttattattcatcaggaatacaaagtctcagaaggcaattatgatattgccttaataaagcttcagacgcccctgaattatactgaattccaaaaaccaatatgcctgccttccaaagctgacacaaatacaatttataccaactgttgggtgactggatggggctacacgaaggaacaaggtgaaacgcaaaatattctacaaaaggctactattcctttggtaccaaatgaagaatgccagaaaaaatacagagattatgttataaacaagcagatgatctgtgctggctacaaagaaggcggaacagacgcttgtaagggagattccggtggccccttagtctgtaaacacagtggacggtggcagttggtgggtatcaccagctggggtgaaggctgcgcccgcaaggaccaaccaggagtctacaccaaagtttctgagtacatggactggatattggagaagacacagagcagtgatgtaagagctctggagacatcttcagcctgaggaggctgggtaccaaggaggaagaacccagctggctttaccacctgccctcaaggcaaactagagctccaggattctcggctgtaaaatgttgataatggtgtctacctcacatccgtatcattggattgaaaattcaagtgtagatatagttgctgaagacagcgttttgctcaagtgtgtttcctgccttgagtcacaggagctccaatgggagcattacaaagatcaccaagcttgttaggaaagagaatgatcaaagggttttattaggtaatgaaatgtctagatgtgatgcaattgaaaaaaagaccccagattctagcacagtccttgggaccattctcatgtaactgttgactctggacctcagcagatctcagagttacctgtccacttctgacatttgtttattagagcctgatgctattctttcaagtggagcaaaaaaaaaaaaaaa

SEQ ID NO: 4 - DNA, 2472 bp, Mus musculus
  source 1..2472: mol_type = genomic DNA
tttttttttttttttgctccacttgaaagaatagcatcaggctctaataaacaaatgtcagaagtggacaggtaactctgagatctgctgaggtccagagtcaacagttacatgagaatggtcccaaggactgtgctagaatctggggtctttttttcaattgcatcacatctagacatttcattacctaataaaaccctttgatcattctctttcctaacaagcttggtgatctttgtaatgctcccattggagctcctgtgactcaaggcaggaaacacacttgagcaaaacgctgtcttcagcaactatatctacacttgaattttcaatccaatgatacggatgtgaggtagacaccattatcaacattttacagccgagaatcctggagctctagtttgccttgagggcaggtggtaaagccagctgggttcttcctccttggtacccagcctcctcaggctgaagatgtctccagagctcttacatcactgctctgtgtcttctccaatatccagtccatgtactcagaaactttggtgtagactcctggttggtccttgcgggcgcagccttcaccccagctggtgatacccaccaactgccaccgtccactgtgtttacagactaaggggccaccggaatctcccttacaagcgtctgttccgccttctttgtagccagcacagatcatctgcttgtttataacataatctctgtattttttctggcattcttcatttggtaccaaaggaatagtagccttttgtagaatattttgcgtttcaccttgttccttcgtgtagccccatccagtcacccaacagttggtataaattgtatttgtgtcagctttggaaggcaggcatattggtttttggaattcagtataattcaggggcgtctgaagctttattaaggcaatatcataattgccttctgagactttgtattcctgatgaataataagctcctttattctcgaggaaggcgtttctttcgtaatctcggacagactaagaattccgccatatatacgccacacatctggatagggaattccatcaaagcaatgggcagctgtcagtacccattggcgaccaatgatggaccctccacacaaatgggtctgagataccagcttcacttgcaggctgacctgccatggccactcccctaaagaagcgtttgttcctcccacaatacgtgcatttatttttgttgtacagtcagggctgtccacaagtttacacaatctcagagaataaccggagctcccctgcatgccataggtgatcctagttggggagccatctgtggataaccttaaggaacatttacacccctcctccttgcagtcttgggggagtaaggagtaaataaaaaactggcagcggattgtctttgtacaagtctcttggcagacatctgctccttgcacgaaggtcacattcagttcttccccttcaaagtcaactccagagtaaattttggaatggcagggttcagggcgagtttttctgcaggtgaggagactatatccagatatagcgttttcttgaggaatagggggacttggtcttccacttttagacgtcttaagaaaacaaacatttctctgtgattctgtctcccattcattcgtgtagaacgtgaagaaaaggcagttgggatggaaggtgcagatggtgcgacacacaaaggcatcgggggtgatgacctggcttacattcaggtctgcaaaggcagagtgctggaaaatatccatggggcaacctatctccgaaagcgcacaggacttcagtgagaatccagacaccaggttgtccgctgactttatgctggtgggtgttccgcttgcactgtgcttcagcaggcacttcttccggtactctggtctgtaaaatgcacttgtagcatatgtgaaaaattggcagtgaaaattatttgtgcacagtttctggcattcttcaatattgtcggtcttagagatattaaagttggaccctctcatatcaagtcctttgtatatgtctcggtggcaagcacttatttgatggccacactgctttaaagaatgaccagaaatggcccctgtccggtgtattcttggcaaagtccctgtaatgctctctttcatgaagcaaccaaaccgtttatttgtctctttgggtggagtcacggcgagaaagctgaacagcaggcacctggggtgaaaagtgcacatcttctgacagtactgggcatctggggtgtagatggcagctagatccccacctctgaagaaggtatttttatacagttgagtcatacacccacaggagacggtagcaaacaaggaaacaaaataacccactcggttgaataaaatcatcctggaaggatggtcacgttgtggttctggaggagagggagtcttcacatgaagatggtcttcaagccctctgaatatggcaccgagggcggtct

SEQ ID NO: 5 - DNA, 2513 bp, Rattus norvegicus
  source 1..2513: mol_type = genomic DNA
tgaagactagcttcatgtgaagactccttctcctccagcagcacaaagcaaccatccttccaggatgattttattcaaacaagtgggttattttgtttccttgttcgctacagtttcctgtgggtgtctgtcacaactgtatgcaaataccttcttcagaggtggggatctggctgccatctacaccccggatgcccagcactgtcagaagatgtgcacgtttcaccccaggtgcctgctcttcagcttccttgccgtgagtccaaccaaggagacagataaaaggtttgggtgcttcatgaaagagagcattacagggactttgccaagaatacaccggacaggggccatttctggtcattctttaaaacagtgtggccatcaattaagtgcttgccaccaagacatatacgaaggactggatatgagagggtccaactttaatatatctaagaccgacagtattgaagaatgccagaaactgtgcacaaataatattcactgccaatttttcacatatgctacaaaagcatttcacagaccagagtacaggaagagttgcctgctgaagcgcagttcaagtggaacgcccaccagtataaagccagtggacaacctggtgtctggattctcactgaagtcctgtgctctctcagagatcggttgccccatggatattttccagcactttgcctttgcagacctgaatgtaagccatgtcgtcacccccgatgccttcgtgtgtcgcaccgtttgcaccttccatcccaactgcctcttcttcacattctacacgaatgagtgggagacggaatcacagaggaatgtttgttttcttaagacatctaaaagtggaagaccaagtccccctattattcaagaaaatgctgtatctggatacagtctcttcacctgcagaaaagctcgccctgaaccctgccatttcaagatttactctggagttgccttcgaaggggaagaactgaacgcgaccttcgtgcagggagcagatgcgtgccaagagacttgtacaaagaccatccgctgtcagttttttacttactcattgcttccccaagactgcaaggcagaggggtgtaaatgttccttaaggttatccacggatggctctccaactaggatcacctatgaggcacaggggagctctggttattctctgagactgtgtaaagttgtggagagctctgactgtacgacaaaaataaatgcacgtattgtgggaggaacaaactcttctttaggagagtggccatggcaggtcagcctgcaagtaaagttggtttctcagaatcatatgtgtggagggtccatcattggacgccaatggatactgacggctgcccattgctttgatgggattccctatccagacgtgtggcgtatatatggcgggattcttaatctgtcagagattacaaacaaaacgcctttctcaagtataaaggagcttattattcatcagaaatacaaaatgtcagaaggcagttacgatattgccttaataaagcttcagacaccgttgaattatactgaattccaaaaaccaatatgcctgccttccaaagctgacacaaatacaatttataccaactgctgggtgactggatggggctacacaaaggaacgaggtgagacccaaaatattctacaaaaggcaactattcccttggtaccaaatgaagaatgccagaaaaaatatagagattatgttataaccaagcagatgatctgtgctggctacaaagaaggtggaatagatgcttgtaagggagattccggtggccccttagtttgcaaacatagtggaaggtggcagttggtgggtatcaccagctggggcgaaggctgtgcccgcaaggagcaaccaggagtctacaccaaagttgctgagtacattgactggatattggagaagatacagagcagcaaggaaagagctctggagacatctccagcatgaggaggctgggtactgatggggaagagcccagctggcaccagctttaccacctgccctcaagtcctactagagctccagagttctcttctgcaaaatgtcgatagtggtgtctacctcgcatccttaccataggattaaaagtccaaatgtagacacagttgctaaagacagcgccatgctcaagcgtgcttcctgccttgagcaacaggaacgccaatgagaactatccaaagattaccaagcctgtttggaaataaaatggtcaaaggatttttattaggtagtgaaattaggtagttgtccttggaaccattctcatgtaactgttgactctggacctcagcagatcacagttaccttctgtccacttctgacatttgtgtactggaacctgatgctgttcttccacttggagcaaagaactgagaaacctggttctatccattgggaaaaagagatctttgtaacatttcctttacaataaaaagatgttctacttggacttgaaaaaaaaaaaaaaaaaaaaaaaaaa

SEQ ID NO: 6 - DNA, 2513 bp, Rattus norvegicus
  source 1..2513: mol_type = genomic DNA
ttttttttttttttttttttttttttcaagtccaagtagaacatctttttattgtaaaggaaatgttacaaagatctctttttcccaatggatagaaccaggtttctcagttctttgctccaagtggaagaacagcatcaggttccagtacacaaatgtcagaagtggacagaaggtaactgtgatctgctgaggtccagagtcaacagttacatgagaatggttccaaggacaactacctaatttcactacctaataaaaatcctttgaccattttatttccaaacaggcttggtaatctttggatagttctcattggcgttcctgttgctcaaggcaggaagcacgcttgagcatggcgctgtctttagcaactgtgtctacatttggacttttaatcctatggtaaggatgcgaggtagacaccactatcgacattttgcagaagagaactctggagctctagtaggacttgagggcaggtggtaaagctggtgccagctgggctcttccccatcagtacccagcctcctcatgctggagatgtctccagagctctttccttgctgctctgtatcttctccaatatccagtcaatgtactcagcaactttggtgtagactcctggttgctccttgcgggcacagccttcgccccagctggtgatacccaccaactgccaccttccactatgtttgcaaactaaggggccaccggaatctcccttacaagcatctattccaccttctttgtagccagcacagatcatctgcttggttataacataatctctatattttttctggcattcttcatttggtaccaagggaatagttgccttttgtagaatattttgggtctcacctcgttcctttgtgtagccccatccagtcacccagcagttggtataaattgtatttgtgtcagctttggaaggcaggcatattggtttttggaattcagtataattcaacggtgtctgaagctttattaaggcaatatcgtaactgccttctgacattttgtatttctgatgaataataagctcctttatacttgagaaaggcgttttgtttgtaatctctgacagattaagaatcccgccatatatacgccacacgtctggatagggaatcccatcaaagcaatgggcagccgtcagtatccattggcgtccaatgatggaccctccacacatatgattctgagaaaccaactttacttgcaggctgacctgccatggccactctcctaaagaagagtttgttcctcccacaatacgtgcatttatttttgtcgtacagtcagagctctccacaactttacacagtctcagagaataaccagagctcccctgtgcctcataggtgatcctagttggagagccatccgtggataaccttaaggaacatttacacccctctgccttgcagtcttggggaagcaatgagtaagtaaaaaactgacagcggatggtctttgtacaagtctcttggcacgcatctgctccctgcacgaaggtcgcgttcagttcttccccttcgaaggcaactccagagtaaatcttgaaatggcagggttcagggcgagcttttctgcaggtgaagagactgtatccagatacagcattttcttgaataatagggggacttggtcttccacttttagatgtcttaagaaaacaaacattcctctgtgattccgtctcccactcattcgtgtagaatgtgaagaagaggcagttgggatggaaggtgcaaacggtgcgacacacgaaggcatcgggggtgacgacatggcttacattcaggtctgcaaaggcaaagtgctggaaaatatccatggggcaaccgatctctgagagagcacaggacttcagtgagaatccagacaccaggttgtccactggctttatactggtgggcgttccacttgaactgcgcttcagcaggcaactcttcctgtactctggtctgtgaaatgcttttgtagcatatgtgaaaaattggcagtgaatattatttgtgcacagtttctggcattcttcaatactgtcggtcttagatatattaaagttggaccctctcatatccagtccttcgtatatgtcttggtggcaagcacttaattgatggccacactgttttaaagaatgaccagaaatggcccctgtccggtgtattcttggcaaagtccctgtaatgctctctttcatgaagcacccaaaccttttatctgtctccttggttggactcacggcaaggaagctgaagagcaggcacctggggtgaaacgtgcacatcttctgacagtgctgggcatccggggtgtagatggcagccagatccccacctctgaagaaggtatttgcatacagttgtgacagacacccacaggaaactgtagcgaacaaggaaacaaaataacccacttgtttgaataaaatcatcctggaaggatggttgctttgtgctgctggaggagaaggagtcttcacatgaagctagtcttca

SEQ ID NO: 7 - DNA, 2115 bp, Macaca fascicularis
  source 1..2115: mol_type = genomic DNA
tttctttgttcttcccatttccatattcataactcttttctcatcttctccacgtgagtttgtgaactagaaattggatagtcattctctgatcctacatgttaaacttgtagagaaaacccagattgtatgtgaggatcatcatcttaaaagtggaggtttggctgcttcttgaaagatagtgttacaggaaccttgccaaaagtacgtcgagcaggtgcaatttctggacattccttaaagcagtgtggtcatcaaataagtgcttgccaccgagacatttataaaggaattgatatgagaggagtcaattttaatgtatctaaggttagcagtgttgaagaatgccaaaaaaggtgcaccaataacattcgctgccaatttttttcatatgccacacaaacatttcacaatgcagagtaccggaacacttgcctcttaaagcacagtcccggaggaacgcctaccactataaaggtgctgaataacgtggaatctggattctcactgaagccttgtgccctttcagaaattggttgtcacatgaacatcttccagcatcttgccttctcggatgtggatgttgccagagttctcgccccagatgcttttgtgtgtcgaaccatctgcacctatcatcccagctgcctcttctttacgttctatacgaatgcatggaagatcgagtcacaaagaaatgtttgttttcttaaaacatctgaaagtggcacaccaagttcctctactcctcaagaaaacaccacatctggatacagccttttaacctgcaaaagaactttacctgaaccctgccattctaaaatttacccgggagttgactttggaggagaagaattgaatgtgactttcgttaaaggagtgaatgtttgccaagagacttgtacaaagatgattcgctgtcagtttttcacttattctttactcccagaagactgtaaggaggagaagtgtaagtgtttcttaagattatcttcggatggttctccaactaggattacatatgggacacaagggagctctggttactctttgagattgtgtaacactggggacagctctgtctgcacaacaaaaacaagctcacgcattgttggaggaacaaactcttcttggggagagtggccctggcaagtgagcctgcaggtgaagctgatggctcagaggcacctgtgtggagggtcactcataggacaccagtgggtcctcactgctgcccactgctttgatgggcttcccttaccggatgtttggcgcatttatagtggcattttaaatctgtcagacattacaaaagaaacacctttctcacaaataaaagagatcattattcaccaaaactatagaatctcagaagggaatcatgatatcgccttaataaaactccaggctcctttgaattacactgaattccaaaaaccaatatgcctaccttccaaaggtgacacaaacacaatttataccaactgttgggtaactggatggggcttctcgaaggaaaaaggtgaaatccaagatattctacaaaaggtaaatattcctttggtaacaaatgaagaatgccagaaaagatatcaagattataaaataacccaacggatggtctgtgctggctataaagaagggggaaaagatgcttgtaagggagattcagggggtcccttagcttgcaaacacaatggaatgtggcgtttggtgggcatcaccagctggggcgaaggctgtgcccgcagggagcaacctggtgtctacaccaaagtcgctgagtacatggactggattttagagaaaacacagagcagtgatggaaacgctcggatgcaggcgccagcatgaggagcagcccagagtcttggcgagttttacaacctgggttcaagtcaaattctgagcctgggggtcctcatctgcaaagcatggagagtggcatctactttgcatcctgtcataaggacaaaagacagtgcactcagagctgctgaggacaatgttttgctgaagccagctttcagcattcagtaactgggagctgataatgtgaagtcgcaaccgagatctccatgattgtgtgtcgtaaaataaaatggtaaaagatca

SEQ ID NO: 8 - DNA, 2115 bp, Macaca fascicularis
  source 1..2115: mol_type = genomic DNA
tgatcttttaccattttattttacgacacacaatcatggagatctcggttgcgacttcacattatcagctcccagttactgaatgctgaaagctggcttcagcaaaacattgtcctcagcagctctgagtgcactgtcttttgtccttatgacaggatgcaaagtagatgccactctccatgctttgcagatgaggacccccaggctcagaatttgacttgaacccaggttgtaaaactcgccaagactctgggctgctcctcatgctggcgcctgcatccgagcgtttccatcactgctctgtgttttctctaaaatccagtccatgtactcagcgactttggtgtagacaccaggttgctccctgcgggcacagccttcgccccagctggtgatgcccaccaaacgccacattccattgtgtttgcaagctaagggaccccctgaatctcccttacaagcatcttttcccccttctttatagccagcacagaccatccgttgggttattttataatcttgatatcttttctggcattcttcatttgttaccaaaggaatatttaccttttgtagaatatcttggatttcacctttttccttcgagaagccccatccagttacccaacagttggtataaattgtgtttgtgtcacctttggaaggtaggcatattggtttttggaattcagtgtaattcaaaggagcctggagttttattaaggcgatatcatgattcccttctgagattctatagttttggtgaataatgatctcttttatttgtgagaaaggtgtttcttttgtaatgtctgacagatttaaaatgccactataaatgcgccaaacatccggtaagggaagcccatcaaagcagtgggcagcagtgaggacccactggtgtcctatgagtgaccctccacacaggtgcctctgagccatcagcttcacctgcaggctcacttgccagggccactctccccaagaagagtttgttcctccaacaatgcgtgagcttgtttttgttgtgcagacagagctgtccccagtgttacacaatctcaaagagtaaccagagctcccttgtgtcccatatgtaatcctagttggagaaccatccgaagataatcttaagaaacacttacacttctcctccttacagtcttctgggagtaaagaataagtgaaaaactgacagcgaatcatctttgtacaagtctcttggcaaacattcactcctttaacgaaagtcacattcaattcttctcctccaaagtcaactcccgggtaaattttagaatggcagggttcaggtaaagttcttttgcaggttaaaaggctgtatccagatgtggtgttttcttgaggagtagaggaacttggtgtgccactttcagatgttttaagaaaacaaacatttctttgtgactcgatcttccatgcattcgtatagaacgtaaagaagaggcagctgggatgataggtgcagatggttcgacacacaaaagcatctggggcgagaactctggcaacatccacatccgagaaggcaagatgctggaagatgttcatgtgacaaccaatttctgaaagggcacaaggcttcagtgagaatccagattccacgttattcagcacctttatagtggtaggcgttcctccgggactgtgctttaagaggcaagtgttccggtactctgcattgtgaaatgtttgtgtggcatatgaaaaaaattggcagcgaatgttattggtgcaccttttttggcattcttcaacactgctaaccttagatacattaaaattgactcctctcatatcaattcctttataaatgtctcggtggcaagcacttatttgatgaccacactgctttaaggaatgtccagaaattgcacctgctcgacgtacttttggcaaggttcctgtaacactatctttcaagaagcagccaaacctccacttttaagatgatgatcctcacatacaatctgggttttctctacaagtttaacatgtaggatcagagaatgactatccaatttctagttcacaaactcacgtggagaagatgagaaaagagttatgaatatggaaatgggaagaacaaagaaa

SEQ ID NO: 9 - DNA, 2060 bp, Homo sapiens
  source 1..2060: mol_type = genomic DNA
ctattgatctggactcctggataggcagctggaccaacggacggatgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggagccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgctgagaaaaaaaaaaa

SEQ ID NO: 10 - DNA, 2060 bp, Homo sapiens
  source 1..2060: mol_type = genomic DNA
tttttttttttctcagcattttcaaagcactttattgagttcctgcgccatcctggcgcggagctggccgcactgggggaatgggacacaatcttgccttccatgccccagccactctctcactgcggaatcaccaaggagggaaagatgagtccctgagcaatcaggaaacggtgtgctcccggatccaggccaggtagtaggccacatcggtgtagacgcctggcttgttgcggtcaccacagcccgatccccagctgatgatgccttgcagggtgagccggcgctctgcagcttggtcctcacacaccagcgggcctccggaatcaccctggcacgcatcggtgccgccctcgaggaaccctgcgcagagcatgccggggaggatggaggatccgtgcacgtccggggctgagcagcgctccagggagaggaacggtacctgcgcctcctgcaggaagctggcatattcctccgccccctcgaactggtggccccagccggccacctggcagagcgtggtctcggagggtcgcgcggcgccgcttggcaggcacaccggctgaacgtaaggcgacaggagcgcgcagctgccgtccgcatcctcctgaaggcgcaacagagccaggtcgtgctggtagctgacgggcgagaaggcctcgtgcaagcggtaggagcgcacggccaacgtctggcacggctcacagctgtggttacggcgttcctggccgagcaccaccgtcagatcctcgggtgcgggccggtcctgcaggcagtgagcggccgtcagcacccagcagggggcgatgaggctgccggcgcagaaactgtggccccagtacagcgcggcgatgtaggggtgcgccccgcgtagcgccaccagcccgccaacgacgcgggtcatcgaagacagactcttgcggagccgctgcccgcagctcagtgggccgttcctggtcagggaaggcggctgctcccgcttcgccggcaaggctcccggggtctgggactgaggcggggtccgggtcgtgggctgaggcttcggcggtgccggctgcgcgggcatgagtgggacatgaagcctaggggacaccggggtcggaggcgccgcctgggttggggtctggcactgtgccaggtcgcagtactcccagctcagccggtcgcggttcagcacgaagcaccacgggcggatgtcgttgtccgggttccggcagaaggcgtggccgcccagtccccagttccgcgcttgctcggcagtcacgttccggtaggtggcctccgaggcccacggctgacagggcgcacccgagagcgtggtcctggccaggccgcggtagctgagcccgcggccatcatagcagcttgccttggtgtccacgtcgcagaaggctccggtgtagcccaccgggcagtggcacaggcggtggccctccacctctaggcagcgacccccatggaggcacgggttggtgcggcaggcctggctggccagccgctggcagtgggcatcaggacccttgcactggcatctggccacagctgcttgctcagttctataccatatctcattcttgtggaaaaaccggagaagctgaggctcaaagcacttctctttctggcagtggtttccagtgaggtgttgtggacagagacagtgggggccgcttggcatgttcacacaggtccctcctttctggcaggggctgtgtttgctgcagtggtctttcactttcttgggctccaaacagtatccccatcgctggtcctgatcaaagttgggggtggtagcacaccagggctgagggcctggccggcccttgtgggtacatttgtggtacagctgccggtggtactggaaggggaagtggcagggctccccggtgacagtgagaacgactgtgtgctcttcagctttgtacttatgctccttgggggcttcccaaggtggaatcgaaagtgttgactccaagctcaccagcaggaaccccaggagcagcagagccctcatggcatccgtccgttggtccagctgcctatccaggagtccagatcaatag

SEQ ID NO: 11 - DNA, 2198 bp, Macaca fascicularis
  source 1..2198: mol_type = genomic DNA
ttcctgactcaagtccagagcttccctaccttgcttctaaggtgaccaaggaagtcagtccacttggctttccataaacagcctgtgccccaccaggctcaggggggcagcttgaccaatccctatttccaagacctttggccaaccctattgatctggactcctgggcagacagttggaccaacggacagacgccatgagggctctgctgctcatggggttcctgctggtgagcctggagtcaacactttcgattccaccttggaaagcgcccaaggagcataagtacaaagctgaagagcacacagtcgttctcactgtcaccggggagccctgccacttccccttccagtaccaccggcggctgtaccacaaatgtacccacaagggccggccaggccctcagacctggtgtgctaccacccctaactttgatgaggaccagcgctggggatactgtgtggagcccaagaaagtgaaagaccactgcagtaaacacagcccctgccagaaaggggggacctgtgtgaacacgctgagtggcacccactgtctctgtccacaacacctcactgggaaccactgccagagagagaagtgctttgagcctcagcttctccggtttttccacgagaatgagatatggtatagatctgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgccccgtgggctacaccggacccttctgcgacttggacaccaaggcgagctgctatgatggccgcgggctcagctaccgcggcctggccaggaccacgctctcgggtgcgccctgtcagccgtggacctcggaggccacctactggaacgtgacggccgagcaagcgcggaactggggactgggcggccacgccttctgccggaacccggacaacgacatccgcccgtggtgcttcgtgctgatcggcgacaggctaagctgggagtactgcgacgtggcacagtgccaggccccaacccaggcggcgcctccgacgccggtgtcccctgggcttcatgtcccactcatgcccccgcagccggcaccgccgaagcttcagcccacgacccggaccccgcctcagtcccagaccccgggagccttgccagtgaagcgggagcagccgcctcgcctgacccggaacggctcagtgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggccggcacccgaggatctgacggtagtactcggccaggaacgccataaccacagctgtgaacagtgccagactctggccgtgcgctcctaccgcttgcacgaggccttctcgcccgacagctaccagcacgacctggctctgttgcgccttcaggaggatgcggacggcagctgcgcgctcctgtcgccttacgttcagccggtgtgcctgccaagcggcgccgcgcgaccctccgagcccgcgctctgccaggtggctggctggggccaccagttcgagggggcggaggaatattccagcttcctgcaggaggcgcaggtacccttcctctccctggagagctgctcagcaccggaggtgcacggagcctccatcctccccggcatgctctgcgcagggttcctcgagggcggcaccgatgcatgccagggtgattccggaggcccgctggtgtgtgaggaccaagccgcagagcgccggctcaccctgcaaggcatcatcagctggggatcgggctgtggtgaccgcaacaagccaggcgtctacaccgatgtggcctactacctggcctggatccgggagcacaccgcttcctgattgctcagggactcatctttccctcctcggtgattccgcagtgggagactggctggggcatggaaggcaaaattgtgtcccattcccccaatgcggccagctccgcgccaggatggcgcaggaactcaataaagtgctttgaaaatgctgagaa

SEQ ID NO: 12 - DNA, 2198 bp, Macaca fascicularis
  source 1..2198: mol_type = genomic DNA
ttctcagcattttcaaagcactttattgagttcctgcgccatcctggcgcggagctggccgcattgggggaatgggacacaattttgccttccatgccccagccagtctcccactgcggaatcaccgaggagggaaagatgagtccctgagcaatcaggaagcggtgtgctcccggatccaggccaggtagtaggccacatcggtgtagacgcctggcttgttgcggtcaccacagcccgatccccagctgatgatgccttgcagggtgagccggcgctctgcggcttggtcctcacacaccagcgggcctccggaatcaccctggcatgcatcggtgccgccctcgaggaaccctgcgcagagcatgccggggaggatggaggctccgtgcacctccggtgctgagcagctctccagggagaggaagggtacctgcgcctcctgcaggaagctggaatattcctccgccccctcgaactggtggccccagccagccacctggcagagcgcgggctcggagggtcgcgcggcgccgcttggcaggcacaccggctgaacgtaaggcgacaggagcgcgcagctgccgtccgcatcctcctgaaggcgcaacagagccaggtcgtgctggtagctgtcgggcgagaaggcctcgtgcaagcggtaggagcgcacggccagagtctggcactgttcacagctgtggttatggcgttcctggccgagtactaccgtcagatcctcgggtgccggccggtcctgcaggcagtgagcggccgtcagcacccagcagggggcgatgaggctgccggcgcagaaactgtggccccagtacagcgcggcgatgtaggggtgcgccccgcgtagcgccaccagcccgccaacgacgcgggtcatcgaagacagactcttgcggagccgctgcccgcagctcactgagccgttccgggtcaggcgaggcggctgctcccgcttcactggcaaggctcccggggtctgggactgaggcggggtccgggtcgtgggctgaagcttcggcggtgccggctgcgggggcatgagtgggacatgaagcccaggggacaccggcgtcggaggcgccgcctgggttggggcctggcactgtgccacgtcgcagtactcccagcttagcctgtcgccgatcagcacgaagcaccacgggcggatgtcgttgtccgggttccggcagaaggcgtggccgcccagtccccagttccgcgcttgctcggccgtcacgttccagtaggtggcctccgaggtccacggctgacagggcgcacccgagagcgtggtcctggccaggccgcggtagctgagcccgcggccatcatagcagctcgccttggtgtccaagtcgcagaagggtccggtgtagcccacggggcagtggcacaggcggtggccctccacctctaggcagcgacccccatggaggcacgggttggtgcggcaggcctggctggccagccgctggcagtgggcatcaggacccttgcactggcatctggccacagctgcttgctcagatctataccatatctcattctcgtggaaaaaccggagaagctgaggctcaaagcacttctctctctggcagtggttcccagtgaggtgttgtggacagagacagtgggtgccactcagcgtgttcacacaggtcccccctttctggcaggggctgtgtttactgcagtggtctttcactttcttgggctccacacagtatccccagcgctggtcctcatcaaagttaggggtggtagcacaccaggtctgagggcctggccggcccttgtgggtacatttgtggtacagccgccggtggtactggaaggggaagtggcagggctccccggtgacagtgagaacgactgtgtgctcttcagctttgtacttatgctccttgggcgctttccaaggtggaatcgaaagtgttgactccaggctcaccagcaggaaccccatgagcagcagagccctcatggcgtctgtccgttggtccaactgtctgcccaggagtccagatcaatagggttggccaaaggtcttggaaatagggattggtcaagctgcccccctgagcctggtggggcacaggctgtttatggaaagccaagtggactgacttccttggtcaccttagaagcaaggtagggaagctctggacttgagtcaggaa

SEQ ID NO: 13 - DNA, 1971 bp, Mus musculus
  source 1..1971: mol_type = genomic DNA
actcctgggcaggcagcggggccatcggcagacgccatgacggctctgttgttcctggggtctctgctgatgagtctggatctgacactttcggctccaccatggaaagactccaagaaatttaaggacgcacctgatgggcccacagtggttctcactgtggatgggaggctctgccattttccctttcagtaccaccgtcagctacaccacaaatgcatccacaaaaggcggccaggctcccgcccctggtgtgctaccacccccaactttgatgaagatcagcaatggggatactgcttggagcccaagaaagtgaaagaccattgcagcaaacacaacccgtgccacaaaggagggacatgtatcaacacccccaatgggccacactgtctctgccctgaacacctcactgggaaacattgccagaaagagaaatgctttgagcctcagcttctcaagttcttccacgagaatgagctatggtttagaacggggccaggaggtgtggccaggtgcgagtgcaaaggttctgaggctcactgcaagccggtggccagccaggcctgcagcatcaatccgtgccttaatgggggcagctgcctcctcgtggaggaccacccactgtgccgttgccctacaggctacactggatatttttgcgacttggacctttgggcgacctgctatgaaggcagggggctcagctaccggggccaggctggaactacgcaatcgggtgcgccatgtcagcggtggaccgtggaggccacctaccggaacatgactgagaagcaagcgctaagctggggcctgggccaccacgcattttgccggaacccagataatgacacacgtccatggtgcttcgtctggagtggcgacaggctgagctgggactattgcggcctggagcagtgccagacgccaacgtttgcacctctagttgtccctgagagtcaggaggagtccccgtcccaggcaccatctctgtcccatgcaccaaatgactcgaccgatcatcagacttctctgtccaagaccaacacgatgggctgcggacagaggttccgcaagggactgtcctcgttcatgcgcgtggtgggcggactagtggctctgcctgggtcgcacccctacatcgctgcactgtactggggtaacaacttctgcgcgggcagtctcatcgccccctgttgggtgctgaccgcggctcactgcctgcagaatcggccagcgcccgaggaactgacagtggtacttggtcaagatcgccacaaccagagctgcgagtggtgccagactctggctgtgcgctcctaccgccttcacgagggcttctcctccatcacctaccagcacgacttggctctgctgcgcctgcaggaaagcaaaaccaacagttgcgcgatcctgtcacctcacgttcagcctgtgtgtctacccagcggcgcggccccaccctctgagacagtgctctgcgaggtggccggctggggtcaccagttcgagggggctgaagaatactccaccttcctgcaggaggcacaggttccctttatcgccctggatcgctgctccaactctaacgtgcacggagacgccattctccctgggatgctttgcgctggcttcttggagggaggcaccgatgcctgccagggtgactccgggggccctctggtgtgtgaggaaggaactgcagaacatcagctcaccctgcgcggagtcatcagctggggctccggctgtggtgaccgcaacaagcccggagtctacacagacgtggccaactacctggcttggatccagaagcatattgcttcataactaaccaggctttatccttccctccttgtgtgctccttgggatgggacgatgaatgtggcatgctgggtcacagtgaagctagtgccccgacactgggggcacagaaactcaataaagtgctttgaaaacgttcctcagaa

SEQ ID NO: 14 - DNA, 1971 bp, Mus musculus
  source 1..1971: mol_type = genomic DNA
ttctgaggaacgttttcaaagcactttattgagtttctgtgcccccagtgtcggggcactagcttcactgtgacccagcatgccacattcatcgtcccatcccaaggagcacacaaggagggaaggataaagcctggttagttatgaagcaatatgcttctggatccaagccaggtagttggccacgtctgtgtagactccgggcttgttgcggtcaccacagccggagccccagctgatgactccgcgcagggtgagctgatgttctgcagttccttcctcacacaccagagggcccccggagtcaccctggcaggcatcggtgcctccctccaagaagccagcgcaaagcatcccagggagaatggcgtctccgtgcacgttagagttggagcagcgatccagggcgataaagggaacctgtgcctcctgcaggaaggtggagtattcttcagccccctcgaactggtgaccccagccggccacctcgcagagcactgtctcagagggtggggccgcgccgctgggtagacacacaggctgaacgtgaggtgacaggatcgcgcaactgttggttttgctttcctgcaggcgcagcagagccaagtcgtgctggtaggtgatggaggagaagccctcgtgaaggcggtaggagcgcacagccagagtctggcaccactcgcagctctggttgtggcgatcttgaccaagtaccactgtcagttcctcgggcgctggccgattctgcaggcagtgagccgcggtcagcacccaacagggggcgatgagactgcccgcgcagaagttgttaccccagtacagtgcagcgatgtaggggtgcgacccaggcagagccactagtccgcccaccacgcgcatgaacgaggacagtcccttgcggaacctctgtccgcagcccatcgtgttggtcttggacagagaagtctgatgatcggtcgagtcatttggtgcatgggacagagatggtgcctgggacggggactcctcctgactctcagggacaactagaggtgcaaacgttggcgtctggcactgctccaggccgcaatagtcccagctcagcctgtcgccactccagacgaagcaccatggacgtgtgtcattatctgggttccggcaaaatgcgtggtggcccaggccccagcttagcgcttgcttctcagtcatgttccggtaggtggcctccacggtccaccgctgacatggcgcacccgattgcgtagttccagcctggccccggtagctgagccccctgccttcatagcaggtcgcccaaaggtccaagtcgcaaaaatatccagtgtagcctgtagggcaacggcacagtgggtggtcctccacgaggaggcagctgcccccattaaggcacggattgatgctgcaggcctggctggccaccggcttgcagtgagcctcagaacctttgcactcgcacctggccacacctcctggccccgttctaaaccatagctcattctcgtggaagaacttgagaagctgaggctcaaagcatttctctttctggcaatgtttcccagtgaggtgttcagggcagagacagtgtggcccattgggggtgttgatacatgtccctcctttgtggcacgggttgtgtttgctgcaatggtctttcactttcttgggctccaagcagtatccccattgctgatcttcatcaaagttgggggtggtagcacaccaggggcgggagcctggccgccttttgtggatgcatttgtggtgtagctgacggtggtactgaaagggaaaatggcagagcctcccatccacagtgagaaccactgtgggcccatcaggtgcgtccttaaatttcttggagtctttccatggtggagccgaaagtgtcagatccagactcatcagcagagaccccaggaacaacagagccgtcatggcgtctgccgatggccccgctgcctgcccaggagt

SEQ ID NO: 15 - DNA, 2128 bp, Rattus norvegicus
  source 1..2128: mol_type = genomic DNA
caggaacccatctcggtactctgcttccaccagccttgccctgctcacgagggttcgacggcgctgttcttctgggctttctgtgaagtctgtgctcctcaggcccaggagggagcttaaccaatctccacctctgaggtttctgagacctttgcccacatctattgatccttactctggggcaggcagctgggccattggcggacgccatgacggctctgttgttcctggggtctctgctgatgagtctggacttgacactttcggcgccaccgtggaagtccaaggagttcaaggacggagctggcgatccctctgtggttctcactgtggacgggaagctctgccactttccctttcagtaccaccgtcgcctgtaccacaaatgcatccacaaaggacagccaggctccaggccctggtgtgctaccacccccaactttgacgaggaccagcaatggggatactgcttggagcccaagaaagtgaaagaccattgcagcaaacacagcccctgccacaaaggagggacgtgtgtcaacacccccaacggcccgcactgtctctgccctgaacacctcaccgggaaacattgccagagagagaaatgctttgagtctcagctcctcaagttcttccatgagaatgagatatggtttagaactgggccaggaggtgtggccaggtgccagtgcaaaggtcctcaggctgtttgcaagctgctgaccagtcaggtttgcagggtcaatccgtgccttaatggaggcacctgcctcctcgtggaggaccaccgactgtgccactgccctgcaggctatgccggacctttttgcgacttagaccttaaggcgacttgctacgaagacaggggtctcagctaccggggccaggctaaaactactctgtcgggtgcaccatgtcagcggtgggcctcggaggccacctaccggaacatgactgagacgcaagctctaagctggggcctgggccaccacgcattctgccggaacccagataatgacacacgtccatggtgctacgtctggagtggcgacaggctgagctgggactactgcgacctggaacagtgccagatgccaacgctcacatctccggtttcccctgagagtcacgacatgctgaagccccggcctcccatattgcagatgcctcagttcccgtctctgtccgatgcactagacaactcgacccgtaatcagaatgttgtgtccaggaccagtacggtggtctgcggacagaggtttcgcaagcgactgtcctcgctcaggcgcgtggtgggcggactagtggctctgcctggatcgcatccctacatcgctgcactgtactggggcgacagcttctgcgcaggcagtctcatcgacccctgctgggtgctgaccgctgctcactgcttgcagaaacggccagcgcccgaggaactgacagtggtacttggtcaagatcgccataaccagagctgcgagaggtgccagactctggctgtgcactcctaccgccttcacgagggcttctcttccaaaacctaccagcatgatttggctctgctgcgcctgcgggggaggaaaaacagctgcgcgatcttgtcgcctcatgtccagccggtgtgtctgcccagcagcgcggccccaccctctgagacagtgctctgcgaggtggccggctggggtcatcagttcgagggggctgaagaatacgccacctttctgcaggaggcacaggtacccttcatctccctggatcgctgctccagctctaacgtgcacggagacgccatcctgcctgggatgctttgtgctggcttcttggagggaggcgccgatgcctgtcagggtgactccgggggtcctctggtatgtgatgaaggagttacagagcgtcagctcaccctgcgaggagtcatcagctggggctccggctgtggtgaccggaacaagcccggggtctacactgacgtggccaattacctggattggatccaggagcatactgctttctaagtaaccagggtcggtccttgcgaagctagtggctgggccccagggacacagaaactcaataaagtgctttgaaaacgttaaaaaaaaaaaaaaaaaaaaaaaaaaaa

SEQ ID NO: 16 - DNA, 2128 bp, Rattus norvegicus
  source 1..2128: mol_type = genomic DNA
ttttttttttttttttttttttttttttaacgttttcaaagcactttattgagtttctgtgtccctggggcccagccactagcttcgcaaggaccgaccctggttacttagaaagcagtatgctcctggatccaatccaggtaattggccacgtcagtgtagaccccgggcttgttccggtcaccacagccggagccccagctgatgactcctcgcagggtgagctgacgctctgtaactccttcatcacataccagaggacccccggagtcaccctgacaggcatcggcgcctccctccaagaagccagcacaaagcatcccaggcaggatggcgtctccgtgcacgttagagctggagcagcgatccagggagatgaagggtacctgtgcctcctgcagaaaggtggcgtattcttcagccccctcgaactgatgaccccagccggccacctcgcagagcactgtctcagagggtggggccgcgctgctgggcagacacaccggctggacatgaggcgacaagatcgcgcagctgtttttcctcccccgcaggcgcagcagagccaaatcatgctggtaggttttggaagagaagccctcgtgaaggcggtaggagtgcacagccagagtctggcacctctcgcagctctggttatggcgatcttgaccaagtaccactgtcagttcctcgggcgctggccgtttctgcaagcagtgagcagcggtcagcacccagcaggggtcgatgagactgcctgcgcagaagctgtcgccccagtacagtgcagcgatgtagggatgcgatccaggcagagccactagtccgcccaccacgcgcctgagcgaggacagtcgcttgcgaaacctctgtccgcagaccaccgtactggtcctggacacaacattctgattacgggtcgagttgtctagtgcatcggacagagacgggaactgaggcatctgcaatatgggaggccggggcttcagcatgtcgtgactctcaggggaaaccggagatgtgagcgttggcatctggcactgttccaggtcgcagtagtcccagctcagcctgtcgccactccagacgtagcaccatggacgtgtgtcattatctgggttccggcagaatgcgtggtggcccaggccccagcttagagcttgcgtctcagtcatgttccggtaggtggcctccgaggcccaccgctgacatggtgcacccgacagagtagttttagcctggccccggtagctgagacccctgtcttcgtagcaagtcgccttaaggtctaagtcgcaaaaaggtccggcatagcctgcagggcagtggcacagtcggtggtcctccacgaggaggcaggtgcctccattaaggcacggattgaccctgcaaacctgactggtcagcagcttgcaaacagcctgaggacctttgcactggcacctggccacacctcctggcccagttctaaaccatatctcattctcatggaagaacttgaggagctgagactcaaagcatttctctctctggcaatgtttcccggtgaggtgttcagggcagagacagtgcgggccgttgggggtgttgacacacgtccctcctttgtggcaggggctgtgtttgctgcaatggtctttcactttcttgggctccaagcagtatccccattgctggtcctcgtcaaagttgggggtggtagcacaccagggcctggagcctggctgtcctttgtggatgcatttgtggtacaggcgacggtggtactgaaagggaaagtggcagagcttcccgtccacagtgagaaccacagagggatcgccagctccgtccttgaactccttggacttccacggtggcgccgaaagtgtcaagtccagactcatcagcagagaccccaggaacaacagagccgtcatggcgtccgccaatggcccagctgcctgccccagagtaaggatcaatagatgtgggcaaaggtctcagaaacctcagaggtggagattggttaagctccctcctgggcctgaggagcacagacttcacagaaagcccagaagaacagcgccgtcgaaccctcgtgagcagggcaaggctggtggaagcagagtaccgagatgggttcctg

SEQ ID NO: 17 - DNA, 2035 bp, Homo sapiens
  source 1..2035: mol_type = genomic DNA
agtgttgcaatgttctagctgtaaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggaga

SEQ ID NO: 18 - DNA, 2035 bp, Homo sapiens
  source 1..2035: mol_type = genomic DNA
tctccgtcactttttactttattgattttcaatttgcttctttacctggatcagaaagataatttcaaattgtttggaggttgagtattttctgatagtgagaagttggtagacattctattaacagagatgattttaaaaatatttttggtaattaactggaccataagaaaacaatactaaacaagccaaattactcttagctaaggcttggaaatctggagaaagaggaagaagagaaggagagagtccttagattactggtagaagcatgacctactaactcttcttttagcacccgtggtggtaaggaagtcccgcctaaggacttctgccttggctagggaatgttccagtgttgggttatgagcctccatggcagagccacagcactgactctctgaccagctggaatttgctgcagaatgggtagggctgaaaggagaccactgtgaattagagttagaacatcaagactgatctttatttcacccagaggcagagtgataaaatggcattcttctctatttaaattctatcccatctttcttcttgtccttcctctcaaggttgctggcagaggtggttggggctatgtgcctggagtgaagattctgcccattggtcaagagacctccctctcagatgctggctctgcccctgcctttgggggtcgacccttgtactcgcaggaccttaggtgactagttgtttcttcttttatttcccctattcgtgatgatcggaaaggtgaaaaacctggaggccttttcatcagtgagatcattcccagtggttgacagttgacagtagggtaaatttttttctcccagggtaccacataaacttcagcgttgcaatctaggctttggccaagttttttggtctcacagctttcggtcaactcttcattactttccttggaacatgtggtttccctggccacgaagtcaataaaatatttcttgccagccaccacctgtactcttgcttttttcacattgtcaatcttgaaatagaaagttgcgttattctctgcattaagctttgtgatggtgtgagtcagtgtctcctccagctctgggctgttggtgggtatatctctggggcagcccacgcaaatcttggtaggtggttgtacaaaatccttccctggataaatgtcacagttctgtgagaaggaagcaattcgtagctgaatatcgatgtatgcattatctgtacattcaccggtatcctgtctttgggcccgttttacttcattaagcatgaagagggaggaatgttgagtgttgttgttaaagtactgaatgccgtgtctcagaatgggctccaggtctgggctctgcgttgatataggatgcacacagccgaggcagtcgtactgggctgtcaccacagggccctcggctggagtaatctggcaggtctgggtagccacggagaatttcgtactgctcctcttccccacggttgccgtgcattctccagtggctgcttttgcagcatccttgtactcacagtcctgccaggttttgccactttgaacaggacaatccccctccttgatttcgtacttgaaggaataaaacgtgtcagagccaaccgtcttagtggcttcagttatgcggtacaatacaaactggttgttactttggttttgactgttatatttcttcagagcagcatccacagctttaaataaatccttgtcattgcagtcaatttcctcggactgtgattcctgggttaaacttagtagcagcctggagcagaggaaaaggatggtaattagtttcatgatctaacaatctccctctaggagctgagggatggtttcaccaagaatcaagagccaactgggatactgaatttgacaatctccagcctcttgtttcttctgtcctcctctctgcctcagaactcagggcactggttggattcctgctgccagacgctagttgccttgttcccaaaggttaaatggctctgctgggttatccaaacatatttacagctagaacattgcaacact

SEQ ID NO: 19 - DNA, 2047 bp, Macaca fascicularis
  source 1..2047: mol_type = genomic DNA
ccccagtgttgcaatgttctagccgtaaatatgtttggataacccagcagagccatttaacctttgggaacagggcaactagcgtatggcagcaggaatccaaccagtgccctgagtgctgaggcagagaggaggacagaaaacgagaggctggagattgtcaaattcagtatcccagttggctcttgattcttggtgaaaccatccctcagctcctagagggagactgttagatcatgaaactaattatcatccttttcttctgctccaggctgctactaagtttaacccaggaatcacagtccgaggaaattgactgcaatgataaggatttatttaaagctgtggatgctgctctgaagaaatataacagtcaaaaccaaagtaacaaccagttcgtactgtaccgcataactgaagccactaagatggttcgctctgacacattttattccttcaagtacgaaatcaaggagggggattgtcctgttcaaagtggcaaaacctggcaggactgtgactacaaggatgctgcagaagcggccactggagaatgcacagcaactgtggggaagagggcgagtatgaaattctctgtggctacccagacctgccagattactccagccgagggccctgtggtgacagcccagtataactgccttggctgtgtgcatcctatatcaacgcagagcccagacctggagcccattctgagacacggcgttcagtactttaacaacaatactcaacattcctccctcttcacgcttagtgaagtaaaacgggcccaaagacaggataccggtgaatgtacagataatgcatacgtcgatactcagctacaaattgcttccttctcacagaagtgtgacatttatccaggggaggattttgtacaaccaccttccaagatttgcgtgggctgccccagagatatacccaccaacagcccagagctggaggagacactgactcacaccatcacaaagcttaatgcggagaataacgcaactttctatttcaagattgacaatgtgaaaaaagcaagagtacaggtggtggctggcaagaaatattttattgactttgtggccagggaaaccacatgttccaaggaaagtaatgaagagttgaccgaaagctgtgagaccaaaaaacttggtcaaagcctagattgcaatgctgaagtttatgtggtaccctgggagaagaaaatttaccctactgtcaactgtcaaccactgggaatgatctcattgatgaaaaggcctccaggtttttcacctttccgatcaacacaagtaggggaaataaaagaagaaacaactagtcacctaaggtcctgcgagtacaagggtcgacccccaaaggcaggggcagagccagcatctgagagggaggtctcttgaccaatgggcagaatcttcactccaggcacatagccccagccacctctgccagcaaccttgagaggaaggacaagaagaaagatgggatagaatttaaatagagaagaatgccattttatcactctgcctctgggtgaaataaagatcagtcttgatgttcttactcctggttaattcacagtggtctcctttcggccatacccatcctgcagcaaattccagctggtcagagagtcagtgctgtggctctgccatggaggttcataacccaacactggaacattctctaaccaaggcagaagtgctttggcgggacttccttttagcaccatgggtgctaaaagaagagttagcaggtcatgctactaatctaaggactctctctaccttctcttcttcctctttatccagatttccaagccttagctaagagtaatttggcttgtttagtattgttttcttatagtccagttgattaccaaaaataatttttaaaatcatctctgttaatatgatgtctaccaacttctcattatcagaaaatacctaacctccaaagaaatttgaaattatctttctgatccaggtaaagaagcaaatagaaaatcaataaaataaaaagtgacagacatttt

SEQ ID NO: 20 - DNA, 2047 bp, Macaca fascicularis
  source 1..2047: mol_type = genomic DNA
aaaatgtctgtcactttttattttattgattttctatttgcttctttacctggatcagaaagataatttcaaatttctttggaggttaggtattttctgataatgagaagttggtagacatcatattaacagagatgattttaaaaattatttttggtaatcaactggactataagaaaacaatactaaacaagccaaattactcttagctaaggcttggaaatctggataaagaggaagaagagaaggtagagagagtccttagattagtagcatgacctgctaactcttcttttagcacccatggtgctaaaaggaagtcccgccaaagcacttctgccttggttagagaatgttccagtgttgggttatgaacctccatggcagagccacagcactgactctctgaccagctggaatttgctgcaggatgggtatggccgaaaggagaccactgtgaattaaccaggagtaagaacatcaagactgatctttatttcacccagaggcagagtgataaaatggcattcttctctatttaaattctatcccatctttcttcttgtccttcctctcaaggttgctggcagaggtggctggggctatgtgcctggagtgaagattctgcccattggtcaagagacctccctctcagatgctggctctgcccctgcctttgggggtcgacccttgtactcgcaggaccttaggtgactagttgtttcttcttttatttcccctacttgtgttgatcggaaaggtgaaaaacctggaggccttttcatcaatgagatcattcccagtggttgacagttgacagtagggtaaattttcttctcccagggtaccacataaacttcagcattgcaatctaggctttgaccaagttttttggtctcacagctttcggtcaactcttcattactttccttggaacatgtggtttccctggccacaaagtcaataaaatatttcttgccagccaccacctgtactcttgcttttttcacattgtcaatcttgaaatagaaagttgcgttattctccgcattaagctttgtgatggtgtgagtcagtgtctcctccagctctgggctgttggtgggtatatctctggggcagcccacgcaaatcttggaaggtggttgtacaaaatcctcccctggataaatgtcacacttctgtgagaaggaagcaatttgtagctgagtatcgacgtatgcattatctgtacattcaccggtatcctgtctttgggcccgttttacttcactaagcgtgaagagggaggaatgttgagtattgttgttaaagtactgaacgccgtgtctcagaatgggctccaggtctgggctctgcgttgatataggatgcacacagccaaggcagttatactgggctgtcaccacagggccctcggctggagtaatctggcaggtctgggtagccacagagaatttcatactcgccctcttccccacagttgctgtgcattctccagtggccgcttctgcagcatccttgtagtcacagtcctgccaggttttgccactttgaacaggacaatccccctccttgatttcgtacttgaaggaataaaatgtgtcagagcgaaccatcttagtggcttcagttatgcggtacagtacgaactggttgttactttggttttgactgttatatttcttcagagcagcatccacagctttaaataaatccttatcattgcagtcaatttcctcggactgtgattcctgggttaaacttagtagcagcctggagcagaagaaaaggatgataattagtttcatgatctaacagtctccctctaggagctgagggatggtttcaccaagaatcaagagccaactgggatactgaatttgacaatctccagcctctcgttttctgtcctcctctctgcctcagcactcagggcactggttggattcctgctgccatacgctagttgccctgttcccaaaggttaaatggctctgctgggttatccaaacatatttacggctagaacattgcaacactgggg

SEQ ID NO: 21 - DNA, 1612 bp, Mus musculus
  source 1..1612: mol_type = genomic DNA
agagtcctgtttgttctctgggaagagggcacacaagaggtgacttcaagaatctaaataggggcctaagtggtgaggcagagagagctgaggcaggagagatcagagcccggaggctgccaaaatcagcttctgagttggtttcccattcttggcaaaacagtccctcagttctagagggacccttaaatcatgaagctcattactacactgctcctctgctccggactcctgctgactttaacacagggagaagaagcgcaggaaattgactgcaatgatgaggctgtatttcaggctgtggatgcctctctgaagaagcttaatgctaggttacaaagcggcaaccagtttgtgttgtaccgagtgaccaagcgcgctaaaatggatggctctgcaaccttttattccttcaattatcaaatcaaggagggcaactgctctgctcagagaggcctggcgtggcaggactgtgacttcaaggactctgaggaagccgccactggagaatgcacagcaactatggggaagaaagaaaataagtttttcatagtcacccagacctgcaagattactccaggtaagggccccatagtgacagaggagtaccactgtgcgagttgtgtgcatcccatatcggcagataatccagacctggagcctgttttgaaacacgccatcgaatatttcaacaacaacacaggtcacagccacctctttgctctcagagaagtaaaaagtgcccaaggacaggtggtgggtggcctgaattttgacattatctacacaattgtgcaaacaaattgttcaaaggagcgttttccttccctccgtggagactgtgtggcacttcccaatggtgatggtggtgagtgtagaggtaatgctttcctggatactgataacaaaattgaggacttcacgcagagctgtgaccttcatccaggagatgatttggtagaagcgcttcccaagccttgccctggctgccccagggacatacctgtagacagcccagagctgaaggaggtgcttggtcattccattgcacagctaaatacagagaatgaccatcctttctatttcaagattgacaccgtgaaaaaagcaacatcacaggtggtagcaggaactaattatgttattgagttcatagccagagaaaccaaatgttccaaggaaagtaacacagagctgacagaagattgtgagatcaagcaccttggacaaagtctcgactgcaatgctaacgtgtacatgagaccttgggagaacaaagtcatcccgactgtgaaatgccaagcattagataagactattcctatccgaaggaggcctccaggcttttctcctttccggtcagccaaagtacaagaaacaaaagcaggaacaactaggctcctacgcgcgtgcgagtacaagggcagactctcaaaggcaggggcagagccagcgcctgagcgtcaggcagaatcttcacaagtgaagcagtagtcccagcaatgacccagagggaaggagcagaagaatcctgagatgtgtggagcgcgggaccatcgtcttcatcaccctgatcctagtggaaataaaattcagagttgatgattttaca

SEQ ID NO: 22 - DNA, 1612 bp, Mus musculus
  source 1..1612: mol_type = genomic DNA
tgtaaaatcatcaactctgaattttatttccactaggatcagggtgatgaagacgatggtcccgcgctccacacatctcaggattcttctgctccttccctctgggtcattgctgggactactgcttcacttgtgaagattctgcctgacgctcaggcgctggctctgcccctgcctttgagagtctgcccttgtactcgcacgcgcgtaggagcctagttgttcctgcttttgtttcttgtactttggctgaccggaaaggagaaaagcctggaggcctccttcggataggaatagtcttatctaatgcttggcatttcacagtcgggatgactttgttctcccaaggtctcatgtacacgttagcattgcagtcgagactttgtccaaggtgcttgatctcacaatcttctgtcagctctgtgttactttccttggaacatttggtttctctggctatgaactcaataacataattagttcctgctaccacctgtgatgttgcttttttcacggtgtcaatcttgaaatagaaaggatggtcattctctgtatttagctgtgcaatggaatgaccaagcacctccttcagctctgggctgtctacaggtatgtccctggggcagccagggcaaggcttgggaagcgcttctaccaaatcatctcctggatgaaggtcacagctctgcgtgaagtcctcaattttgttatcagtatccaggaaagcattacctctacactcaccaccatcaccattgggaagtgccacacagtctccacggagggaaggaaaacgctcctttgaacaatttgtttgcacaattgtgtagataatgtcaaaattcaggccacccaccacctgtccttgggcactttttacttctctgagagcaaagaggtggctgtgacctgtgttgttgttgaaatattcgatggcgtgtttcaaaacaggctccaggtctggattatctgccgatatgggatgcacacaactcgcacagtggtactcctctgtcactatggggcccttacctggagtaatcttgcaggtctgggtgactatgaaaaacttattttctttcttccccatagttgctgtgcattctccagtggcggcttcctcagagtccttgaagtcacagtcctgccacgccaggcctctctgagcagagcagttgccctccttgatttgataattgaaggaataaaaggttgcagagccatccattttagcgcgcttggtcactcggtacaacacaaactggttgccgctttgtaacctagcattaagcttcttcagagaggcatccacagcctgaaatacagcctcatcattgcagtcaatttcctgcgcttcttctccctgtgttaaagtcagcaggagtccggagcagaggagcagtgtagtaatgagcttcatgatttaagggtccctctagaactgagggactgttttgccaagaatgggaaaccaactcagaagctgattttggcagcctccgggctctgatctctcctgcctcagctctctctgcctcaccacttaggcccctatttagattcttgaagtcacctcttgtgtgccctcttcccagagaacaaacaggactct

SEQ ID NO: 23 - DNA, 1674 bp, Rattus norvegicus
  source 1..1674: mol_type = genomic DNA
aggtcaacaaccccttgttgcaatgccccagctgggtacctgcttggacgtggagcagagtcctgtttgttctctgagaagagggcaaacaaggggtgactgcaggaatctaaaagggaccagagtggcgagacagagagagcataggcaggagaagtcagagactggaggctgctaaaagcagcttctgagttggtttcctggtcttggcaaaacaattcctcaattccagagggaacctttaatcatgaagctaattactatcctgctcctctgctccaggctcctgccaagtttagcgcaggaagaaggcgcccaggaattgaactgcaatgatgagactgtatttcaggctgtggatactgctctgaagaaatataacgctgagttagaaagcggcaaccagtttgtgttgtaccgagtgactaagggcactaagaaggatggcgctgaaacattgtattccttcaagtatcaaatcaaggagggcaactgctctgttcagagtggcctcacctggcaggactgtgacttcaaggacgctgaggaagccgctactggcgaatgcacaacaactttggggaagaaagaaaataaattctccgtagccacccagatctgcaatattactccaggtaagggtcctaagaagacagaggaggacctctgtgtcgggtgtttccaacccataccgatggatagctcagacctgaagcctgttctgaaacacgctgtggagcatttcaacaacaacacgaagcacacccacctctttgctctcagagaagtaaagagtgcccactcacaggtggtggctggcatgaattataaaattatctactccattgtgcaaacaaattgttcaaaggaggattttccttccctccgtgaagactgtgtaccccttccctatggcgatcatggtgagtgtacgggtcatacccacgtggatattcataacacaattgccggcttctcacagagctgtgacctttatccaggagatgatttgtttgaactacttcccaagaattgccgtggctgccccagggagatacctgtagacagcccggagctgaaggaggcacttggtcattccattgcacagcttaatgcacagcataaccatattttctatttcaagattgacaccgtgaaaaaggcaacatcacaggtggttgctggagtaatatatgtgattgagttcatagccagagaaactaactgttccaagcaaagtaaaacagaactgacagcggattgtgagaccaaacacctcggtcaaagcctcaactgcaatgctaacgtgtacatgagaccttgggagaacaaagtcgtcccgactgtcagatgccaagcactagatatgatgatttctaggcctccaggattttcacctttccggctggtgcgagtacaagaaactaaagaaggaacaactaggctcctaaactcatgtgagtacaagggcagactctcaaaggcaagggcaggcccagcacctgaccatcaggcagaagcttcaaccgtgacatcatagcctggcaaagacccggagtggaaggaccagaagactcctgggatgtgtgcagtatggaagcatgtttcttcatcacctgatcctgggtgaaataaagttcagactcgaaaaaaaaaaaaaaaaaaaaaaaaaaa

SEQ ID NO: 24 - DNA, 1674 bp, Rattus norvegicus
  source 1..1674: mol_type = genomic DNA
tttttttttttttttttttttttttttcgagtctgaactttatttcacccaggatcaggtgatgaagaaacatgcttccatactgcacacatcccaggagtcttctggtccttccactccgggtctttgccaggctatgatgtcacggttgaagcttctgcctgatggtcaggtgctgggcctgcccttgcctttgagagtctgcccttgtactcacatgagtttaggagcctagttgttccttctttagtttcttgtactcgcaccagccggaaaggtgaaaatcctggaggcctagaaatcatcatatctagtgcttggcatctgacagtcgggacgactttgttctcccaaggtctcatgtacacgttagcattgcagttgaggctttgaccgaggtgtttggtctcacaatccgctgtcagttctgttttactttgcttggaacagttagtttctctggctatgaactcaatcacatatattactccagcaaccacctgtgatgttgcctttttcacggtgtcaatcttgaaatagaaaatatggttatgctgtgcattaagctgtgcaatggaatgaccaagtgcctccttcagctccgggctgtctacaggtatctccctggggcagccacggcaattcttgggaagtagttcaaacaaatcatctcctggataaaggtcacagctctgtgagaagccggcaattgtgttatgaatatccacgtgggtatgacccgtacactcaccatgatcgccatagggaaggggtacacagtcttcacggagggaaggaaaatcctcctttgaacaatttgtttgcacaatggagtagataattttataattcatgccagccaccacctgtgagtgggcactctttacttctctgagagcaaagaggtgggtgtgcttcgtgttgttgttgaaatgctccacagcgtgtttcagaacaggcttcaggtctgagctatccatcggtatgggttggaaacacccgacacagaggtcctcctctgtcttcttaggacccttacctggagtaatattgcagatctgggtggctacggagaatttattttctttcttccccaaagttgttgtgcattcgccagtagcggcttcctcagcgtccttgaagtcacagtcctgccaggtgaggccactctgaacagagcagttgccctccttgatttgatacttgaaggaatacaatgtttcagcgccatccttcttagtgcccttagtcactcggtacaacacaaactggttgccgctttctaactcagcgttatatttcttcagagcagtatccacagcctgaaatacagtctcatcattgcagttcaattcctgggcgccttcttcctgcgctaaacttggcaggagcctggagcagaggagcaggatagtaattagcttcatgattaaaggttccctctggaattgaggaattgttttgccaagaccaggaaaccaactcagaagctgcttttagcagcctccagtctctgacttctcctgcctatgctctctctgtctcgccactctggtcccttttagattcctgcagtcaccccttgtttgccctcttctcagagaacaaacaggactctgctccacgtccaagcaggtacccagctggggcattgcaacaaggggttgttgacct

SEQ ID NO: 25 - RNA, 23 nt, synthetic construct
  source 1..23: mol_type = other RNA
ttcaaagcactttattgagtttc

SEQ ID NO: 26 - protein, 16 aa, unidentified
  REGION 1..16: note = source = /note="Description of Unknown: RFGF sequence"
AAVALLPAVLLALLAP

SEQ ID NO: 27 - protein, 11 aa, unidentified
  REGION 1..11: note = source = /note="Description of Unknown: RFGF analogue sequence"
AALLPVLLAAP

SEQ ID NO: 28 - protein, 13 aa, Human immunodeficiency virus
GRKKRRQRRRPPQ

SEQ ID NO: 29 - protein, 16 aa, Drosophila sp.
RQIKIWFQNRRMKWKK

SEQ ID NO: 30 - RNA, 21 nt, synthetic construct
  source 1..21: mol_type = other RNA
aatccaaaatattctacaaaa

SEQ ID NO: 31 - RNA, 21 nt, synthetic construct
  source 1..21: mol_type = other RNA
ctggtcatcaaataagtgctt

SEQ ID NO: 32 - RNA, 21 nt, synthetic construct
  source 1..21: mol_type = other RNA
gtggtcatcaaataagtgctt

SEQ ID NO: 33 - RNA, 21 nt, synthetic construct
  source 1..21: mol_type = other RNA
catggactggattttagagaa

SEQ ID NO: 34 - RNA, 21 nt, synthetic construct
  source 1..21: mol_type = other RNA
accaaagtcgctgagtacata

SEQ ID NO: 35 - RNA, 21 nt, synthetic construct
  source 1..21: mol_type = other RNA
gatggactggattttagagaa

SEQ ID NO: 36 - RNA, 21 nt, synthetic construct
  source 1..21: mol_type = other RNA
tatgagaggagtcaattttaa

SEQ ID NO: 37 - RNA, 21 nt, synthetic construct
  source 1..21: mol_type = other RNA
aatgagaggagtcaattttaa

SEQ ID NO: 38 - RNA, 21 nt, synthetic construct
  source 1..21: mol_type = other RNA
tccaaagtcgctgagtacata

SEQ ID NO: 39 - RNA, 21 nt, synthetic construct
  source 1..21: mol_type = other RNA
attctacaaaaggtaaatatt

SEQ ID NO: 40 - RNA, 21 nt, synthetic construct
  source 1..21: mol_type = other RNA
tttctcacaaataaaagagat

SEQ ID NO: 41 - RNA, 21 nt, synthetic construct
  source 1..21: mol_type = other RNA
tatcaagattataaaataaca

SEQ ID NO: 42 - RNA, 21 nt, synthetic construct
  source 1..21: mol_type = other RNA
cttcttgaaagatagtgttaa

SEQ ID NO: 43 - RNA, 21 nt, synthetic construct
  source 1..21: mol_type = other RNA
gaatgtttgccaagagactta

SEQ ID NO: 44 - RNA, 21 nt, synthetic construct
  source 1..21: mol_type = other RNA
atattcctttggtaacaaata

SEQ ID NO: 45 - RNA, 21 nt, synthetic construct
  source 1..21: mol_type = other RNA
cgtcatcaaataagtgcttga

SEQ ID NO: 46 - RNA, 21 nt, synthetic construct
  source 1..21: mol_type = other RNA
tcctgcaaaagaactttacct

SEQ ID NO: 47 - RNA, 21 nt, synthetic construct
  source 1..21: mol_type = other RNA
caatgtttgccaagagactta

SEQ ID NO: 48 - RNA, 21 nt, synthetic construct
  source 1..21: mol_type = other RNA
agacacaagcacaatttataa

SEQ ID NO: 49 - RNA, 21 nt, synthetic construct
  source 1..21: mol_type = other RNA
cgagtcacaaagaaatgttta

SEQ ID NO: 50 - RNA, 21 nt, synthetic construct
  source 1..21: mol_type = other RNA
atcttgaaagatagtgttaca

SEQ ID NO: 51 - RNA, 21 nt, synthetic construct
  source 1..21: mol_type = other RNA
aatgtggtcatcaaataagta

SEQ ID NO: 52 - RNA, 21 nt, synthetic construct
  source 1..21: mol_type = other RNA
gttactctttgagattgtgta

SEQ ID NO: 53 - RNA, 21 nt, synthetic construct
  source 1..21: mol_type = other RNA
gttcttgaaagatagtgttaa

SEQ ID NO: 54 - RNA, 21 nt, synthetic construct
  source 1..21: mol_type = other RNA
gactttggaggagaagaatta

SEQ ID NO: 55 - RNA, 21 nt, synthetic construct
  source 1..21: mol_type = other RNA
acctgcaaaagaactttacct

SEQ ID NO: 56 - RNA, 21 nt, synthetic construct
  source 1..21: mol_type = other RNA
atcgagtcacaaagaaatgtt

SEQ ID NO: 57 - RNA, 21 nt, synthetic construct
  source 1..21: mol_type = other RNA
tgacacaagcacaatttataa

SEQ ID NO: 58 - RNA, 21 nt, synthetic construct
  source 1..21: mol_type = other RNA
ggtcatcaaataagtgcttga

SEQ ID NO: 59 - RNA, 21 nt, synthetic construct
  source 1..21: mol_type = other RNA
tggtcatcaaataagtgctta

SEQ ID NO: 60 - RNA, 21 nt, synthetic construct
  source 1..21: mol_type = other RNA
agccagaaaagatatcaagat

SEQ ID NO: 61 - RNA, 21 nt, synthetic construct
  source 1..21: mol_type = other RNA
cttactctttgagattgtgta

SEQ ID NO: 62 - RNA, 21 nt, synthetic construct
  source 1..21: mol_type = other RNA
tttctacaaaaggtaaatatt

SEQ ID NO: 63 - RNA, 21 nt, synthetic construct
  source 1..21: mol_type = other RNA
cacaatggaatgtggcgttta

SEQ ID NO: 64 - RNA, 21 nt, synthetic construct
  source 1..21: mol_type = other RNA
ttactctttgagattgtgtaa

SEQ ID NO: 65 - RNA, 21 nt, synthetic construct
  source 1..21: mol_type = other RNA
tactctttgagattgtgtaaa

SEQ ID NO: 66 - RNA, 21 nt, synthetic construct
  source 1..21: mol_type = other RNA
tgccagaaaagatatcaagat

SEQ ID NO: 67 - RNA, 21 nt, synthetic construct
  source 1..21: mol_type = other RNA
ttcttgaaagatagtgttaca

SEQ ID NO: 68 - RNA, 21 nt, synthetic construct
  source 1..21: mol_type = other RNA
gacaatggaatgtggcgttta

SEQ ID NO: 69 - RNA, 21 nt, synthetic construct
  source 1..21: mol_type = other RNA
aataaaataacccaacggata

SEQ ID NO: 70 - RNA, 21 nt, synthetic construct
  source 1..21: mol_type = other RNA
cttaaaacatctgaaagtgga

SEQ ID NO: 71 - RNA, 21 nt, synthetic construct
  source 1..21: mol_type = other RNA
aatcaagattataaaataaca

SEQ ID NO: 72 - RNA, 21 nt, synthetic construct
  source 1..21: mol_type = other RNA
agtaacgtggaatctggatta

SEQ ID NO: 73 - RNA, 21 nt, synthetic construct
  source 1..21: mol_type = other RNA
tataaaggagttgatatgaga

SEQ ID NO: 74 - RNA, 21 nt, synthetic construct
  source 1..21: mol_type = other RNA
atactctttgagattgtgtaa

SEQ ID NO: 75 - RNA, 21 nt, synthetic construct
  source 1..21: mol_type = other RNA
aataaaggagttgatatgaga

SEQ ID NO: 76 - RNA, 21 nt, synthetic construct
  source 1..21: mol_type = other RNA
cactttggaggagaagaatta

SEQ ID NO: 77 - RNA, 21 nt, synthetic construct
  source 1..21: mol_type = other RNA
tataaaataacccaacggata

SEQ ID NO: 78 - RNA, 21 nt, synthetic construct
  source 1..21: mol_type = other RNA
gaatgtggtcatcaaataagt

SEQ ID NO: 79 - RNA, 21 nt, synthetic construct
  source 1..21: mol_type = other RNA
tgtaacgtggaatctggatta

SEQ ID NO: 80 - RNA, 21 nt, synthetic construct
  source 1..21: mol_type = other RNA
ttcgagtcacaaagaaatgtt

SEQ ID NO: 81 - RNA, 21 nt, synthetic construct
  source 1..21: mol_type = other RNA
ttattcctttggtaacaaata

SEQ ID NO: 82 - RNA, 21 nt, synthetic construct
  source 1..21: mol_type = other RNA
acacaagcacaatttatacca

SEQ ID NO: 83 - RNA, 21 nt, synthetic construct
  source 1..21: mol_type = other RNA
ctggaatctggattctcacta

SEQ ID NO: 84 - RNA, 21 nt, synthetic construct
  source 1..21: mol_type = other RNA
gttaaaacatctgaaagtgga

SEQ ID NO: 85 - RNA, 21 nt, synthetic construct
  source 1..21: mol_type = other RNA
aactctttgagattgtgtaaa

SEQ ID NO: 86 - RNA, 21 nt, synthetic construct
  source 1..21: mol_type = other RNA
gcaatgtggtcatcaaataaa

SEQ ID NO: 87 - RNA, 21 nt, synthetic construct
  source 1..21: mol_type = other RNA
gtggaatctggattctcacta

SEQ ID NO: 88 - RNA, 21 nt, synthetic construct
  source 1..21: mol_type = other RNA
ggcattgttggaggaacaaaa

SEQ ID NO: 89 - RNA, 21 nt, synthetic construct
  source 1..21: mol_type = other RNA
tttgttggaggaacaaactct

SEQ ID NO: 90 - RNA, 21 nt, synthetic construct
  source 1..21: mol_type = other RNA
ggagtcacaaagaaatgttta

SEQ ID NO: 91 - RNA, 21 nt, synthetic construct
  source 1..21: mol_type = other RNA
attgttggaggaacaaactct

SEQ ID NO: 92 - RNA, 21 nt, synthetic construct
  source 1..21: mol_type = other RNA
tatgtggtcatcaaataagta

SEQ ID NO: 93 - RNA, 21 nt, synthetic construct
  source 1..21: mol_type = other RNA
caaaagatgcttgtaagggaa

SEQ ID NO: 94 - RNA, 21 nt, synthetic construct
  source 1..21: mol_type = other RNA
gtctgtgctggctataaagaa

SEQ ID NO: 95 - RNA, 21 nt, synthetic construct
  source 1..21: mol_type = other RNA
agcagtgttgaagaatgccaa

SEQ ID NO: 96 - RNA, 21 nt, synthetic construct
  source 1..21: mol_type = other RNA
gtgtgtggagggtcactcata

SEQ ID NO: 97 - RNA, 21 nt, synthetic construct
  source 1..21: mol_type = other RNA
gaaaagatgcttgtaagggaa

SEQ ID NO: 98 - RNA, 21 nt, synthetic construct
  source 1..21: mol_type = other RNA
acatctgaaagtggcacacca

SEQ ID NO: 99 - RNA, 21 nt, synthetic construct
  source 1..21: mol_type = other RNA
ctctgtgctggctataaagaa

SEQ ID NO: 100 - RNA, 21 nt, synthetic construct
  source 1..21: mol_type = other RNA
tgcagtgttgaagaatgccaa

SEQ ID NO: 101 - RNA, 21 nt, synthetic construct
  source 1..21: mol_type = other RNA
ttcttaaaacatctgaaagta

SEQ ID NO: 102 - RNA, 21 nt, synthetic construct
  source 1..21: mol_type = other RNA
tagcacaatttataccaacta

SEQ ID NO: 103 - RNA, 21 nt, synthetic construct
  source 1..21: mol_type = other RNA
tggaatgtggcgtttggtgga

SEQ ID NO: 104 - RNA, 21 nt, synthetic construct
  source 1..21: mol_type = other RNA
ccaatgtggtcatcaaataaa

SEQ ID NO: 105 - RNA, 21 nt, synthetic construct
  source 1..21: mol_type = other RNA
ctgtgtggagggtcactcata

SEQ ID NO: 106 - RNA, 21 nt, synthetic construct
  source 1..21: mol_type = other RNA
tcatctgaaagtggcacacca

SEQ ID NO: 107 - RNA, 21 nt, synthetic construct
  source 1..21: mol_type = other RNA
ccacaatttataccaactgtt

SEQ ID NO: 108 - RNA, 21 nt, synthetic construct
  source 1..21: mol_type = other RNA
cacaagcacaatttataccaa

SEQ ID NO: 109 - RNA, 21 nt, synthetic construct
  source 1..21: mol_type = other RNA
aggaatgtggcgtttggtgga

SEQ ID NO: 110 - RNA, 21 nt, synthetic construct
  source 1..21: mol_type = other RNA
gcacaatttataccaactgtt

SEQ ID NO: 111 - RNA, 21 nt, synthetic construct
  source 1..21: mol_type = other RNA
cgcattgttggaggaacaaaa

SEQ ID NO: 112 - RNA, 21 nt, synthetic construct
  source 1..21: mol_type = other RNA
aagcacaatttataccaacta

SEQ ID NO: 113 - RNA, 21 nt, synthetic construct
  source 1..21: mol_type = other RNA
gacaagcacaatttataccaa

SEQ ID NO: 114 - RNA, 21 nt, synthetic construct
  source 1..21: mol_type = other RNA
ttttacccgggagttgacttt

SEQ ID NO: 115 - RNA, 21 nt, synthetic construct
  source 1..21: mol_type = other RNA
atttacccgggagttgacttt

SEQ ID NO: 116 - RNA, 21 nt, synthetic construct
  source 1..21: mol_type = other RNA
tcacaagcacaatttatacca

SEQ ID NO: 117 - RNA, 23 nt, synthetic construct
  source 1..23: mol_type = other RNA
ttttgtagaatattttggatttc

SEQ ID NO: 118 - RNA, 23 nt, synthetic construct
  source 1..23: mol_type = other RNA
aagcacttatttgatgaccagat

SEQ ID NO: 119 - RNA, 23 nt, synthetic construct
  source 1..23: mol_type = other RNA
aagcacttatttgatgaccacat

SEQ ID NO: 120 - RNA, 23 nt, synthetic construct
  source 1..23: mol_type = other RNA
ttctctaaaatccagtccatgta

SEQ ID NO: 121 - RNA, 23 nt, synthetic construct
  source 1..23: mol_type = other RNA
tatgtactcagcgactttggtgt

SEQ ID NO: 122 - RNA, 23 nt, synthetic construct
  source 1..23: mol_type = other RNA
ttctctaaaatccagtccatcta

SEQ ID NO: 123 - RNA, 23 nt, synthetic construct
  source 1..23: mol_type = other RNA
ttaaaattgactcctctcatatc

SEQ ID NO: 124 - RNA, 23 nt, synthetic construct
  source 1..23: mol_type = other RNA
ttaaaattgactcctctcatttc

SEQ ID NO: 125 - RNA, 23 nt, synthetic construct
  source 1..23: mol_type = other RNA
tatgtactcagcgactttggagt

SEQ ID NO: 126 - RNA, 23 nt, synthetic construct
  source 1..23: mol_type = other RNA
aatatttaccttttgtagaatat

SEQ ID NO: 127 - RNA, 23 nt, synthetic construct
  source 1..23: mol_type = other RNA
atctcttttatttgtgagaaagg

SEQ ID NO: 128 - RNA, 23 nt, synthetic construct
  source 1..23: mol_type = other RNA
tgttattttataatcttgatatc

SEQ ID NO: 129 - RNA, 23 nt, synthetic construct
  source 1..23: mol_type = other RNA
ttaacactatctttcaagaagca

SEQ ID NO: 130 - RNA, 23 nt, synthetic construct
  source 1..23: mol_type = other RNA
taagtctcttggcaaacattcac

SEQ ID NO: 131 - RNA, 23 nt, synthetic construct
  source 1..23: mol_type = other RNA
tatttgttaccaaaggaatattt

SEQ ID NO: 132 - RNA, 23 nt, synthetic construct
  source 1..23: mol_type = other RNA
tcaagcacttatttgatgacgac

SEQ ID NO: 133 - RNA, 23 nt, synthetic construct
  source 1..23: mol_type = other RNA
aggtaaagttcttttgcaggata

SEQ ID NO: 134 - RNA, 23 nt, synthetic construct
  source 1..23: mol_type = other RNA
taagtctcttggcaaacattgac

SEQ ID NO: 135 - RNA, 23 nt, synthetic construct
  source 1..23: mol_type = other RNA
ttataaattgtgcttgtgtctcc

SEQ ID NO: 136 - RNA, 23 nt, synthetic construct
  source 1..23: mol_type = other RNA
taaacatttctttgtgactcgat

SEQ ID NO: 137 - RNA, 23 nt, synthetic construct
  source 1..23: mol_type = other RNA
tgtaacactatctttcaagatgc

SEQ ID NO: 138 - RNA, 23 nt, synthetic construct
  source 1..23: mol_type = other RNA
tacttatttgatgaccacattgc

SEQ ID NO: 139 - RNA, 23 nt, synthetic construct
  source 1..23: mol_type = other RNA
tacacaatctcaaagagtaacca

SEQ ID NO: 140 - RNA, 23 nt, synthetic construct
  source 1..23: mol_type = other RNA
ttaacactatctttcaagaacca

SEQ ID NO: 141 - RNA, 23 nt, synthetic construct
  source 1..23: mol_type = other RNA
taattcttctcctccaaagtcaa

SEQ ID NO: 142 - RNA, 23 nt, synthetic construct
  source 1..23: mol_type = other RNA
aggtaaagttcttttgcaggtta

SEQ ID NO: 143 - RNA, 23 nt, synthetic construct
  source 1..23: mol_type = other RNA
aacatttctttgtgactcgattt

SEQ ID NO: 144 - RNA, 23 nt, synthetic construct
  source 1..23: mol_type = other RNA
ttataaattgtgcttgtgtcacc

SEQ ID NO: 145 - RNA, 23 nt, synthetic construct
  source 1..23: mol_type = other RNA
tcaagcacttatttgatgaccac

SEQ ID NO: 146 - RNA, 23 nt, synthetic construct
  source 1..23: mol_type = other RNA
taagcacttatttgatgaccaca

SEQ ID NO: 147 - RNA, 23 nt, synthetic construct
  source 1..23: mol_type = other RNA
atcttgatatcttttctggcttt

SEQ ID NO: 148 - RNA, 23 nt, synthetic construct
  source 1..23: mol_type = other RNA
tacacaatctcaaagagtaagca

SEQ ID NO: 149 - RNA, 23 nt, synthetic construct
  source 1..23: mol_type = other RNA
aatatttaccttttgtagaaaat

SEQ ID NO: 150 - RNA, 23 nt, synthetic construct
  source 1..23: mol_type = other RNA
taaacgccacattccattgtgtt

SEQ ID NO: 151 - RNA, 23 nt, synthetic construct
  source 1..23: mol_type = other RNA
ttacacaatctcaaagagtaacc

SEQ ID NO: 152 - RNA, 23 nt, synthetic construct
  source 1..23: mol_type = other RNA
tttacacaatctcaaagagtaac

SEQ ID NO: 153 - RNA, 23 nt, synthetic construct
  source 1..23: mol_type = other RNA
atcttgatatcttttctggcatt

SEQ ID NO: 154 - RNA, 23 nt, synthetic construct
  source 1..23: mol_type = other RNA
tgtaacactatctttcaagaagc

SEQ ID NO: 155 - RNA, 23 nt, synthetic construct
  source 1..23: mol_type = other RNA
taaacgccacattccattgtctt

SEQ ID NO: 156 - RNA, 23 nt, synthetic construct
  source 1..23: mol_type = other RNA
tatccgttgggttattttattat

SEQ ID NO: 157 - RNA, 23 nt, synthetic construct
  source 1..23: mol_type = other RNA
tccactttcagatgttttaagaa

SEQ ID NO: 158 - RNA, 23 nt, synthetic construct
  source 1..23: mol_type = other RNA
tgttattttataatcttgatttc

SEQ ID NO: 159 - RNA, 23 nt, synthetic construct
  source 1..23: mol_type = other RNA
taatccagattccacgttactca

SEQ ID NO: 160 - RNA, 23 nt, synthetic construct
  source 1..23: mol_type = other RNA
tctcatatcaactcctttataaa

SEQ ID NO: 161 - RNA, 23 nt, synthetic construct
  source 1..23: mol_type = other RNA
ttacacaatctcaaagagtatcc

SEQ ID NO: 162 - RNA, 23 nt, synthetic construct
  source 1..23: mol_type = other RNA
tctcatatcaactcctttattaa

SEQ ID NO: 163 - RNA, 23 nt, synthetic construct
  source 1..23: mol_type = other RNA
taattcttctcctccaaagtgaa

SEQ ID NO: 164 - RNA, 23 nt, synthetic construct
  source 1..23: mol_type = other RNA
tatccgttgggttattttataat

SEQ ID NO: 165 - RNA, 23 nt, synthetic construct
  source 1..23: mol_type = other RNA
acttatttgatgaccacattcct

SEQ ID NO: 166 - RNA, 23 nt, synthetic construct
  source 1..23: mol_type = other RNA
taatccagattccacgttacaca

SEQ ID NO: 167 - RNA, 23 nt, synthetic construct
  source 1..23: mol_type = other RNA
aacatttctttgtgactcgaatt

SEQ ID NO: 168 - RNA, 23 nt, synthetic construct
  source 1..23: mol_type = other RNA
tatttgttaccaaaggaataatt

SEQ ID NO: 169 - RNA, 23 nt, synthetic construct
  source 1..23: mol_type = other RNA
tggtataaattgtgcttgtgtca

SEQ ID NO: 170 - RNA, 23 nt, synthetic construct
  source 1..23: mol_type = other RNA
tagtgagaatccagattccaggt

SEQ ID NO: 171 - RNA, 23 nt, synthetic construct
  source 1..23: mol_type = other RNA
tccactttcagatgttttaacaa

SEQ ID NO: 172 - RNA, 23 nt, synthetic construct
  source 1..23: mol_type = other RNA
tttacacaatctcaaagagttac

SEQ ID NO: 173 - RNA, 23 nt, synthetic construct
  source 1..23: mol_type = other RNA
tttatttgatgaccacattgctt

SEQ ID NO: 174 - RNA, 23 nt, synthetic construct
  source 1..23: mol_type = other RNA
tagtgagaatccagattccacgt

SEQ ID NO: 175 - RNA, 23 nt, synthetic construct
  source 1..23: mol_type = other RNA
ttttgttcctccaacaatgcctg

SEQ ID NO: 176 - RNA, 23 nt, synthetic construct
  source 1..23: mol_type = other RNA
agagtttgttcctccaacaaagc

SEQ ID NO: 177 - RNA, 23 nt, synthetic construct
  source 1..23: mol_type = other RNA
taaacatttctttgtgactccat

SEQ ID NO: 178 - RNA, 23 nt, synthetic construct
  source 1..23: mol_type = other RNA
agagtttgttcctccaacaatgc

SEQ ID NO: 179 - RNA, 23 nt, synthetic construct
  source 1..23: mol_type = other RNA
tacttatttgatgaccacatagc

SEQ ID NO: 180 - RNA, 23 nt, synthetic construct
  source 1..23: mol_type = other RNA
ttcccttacaagcatcttttgcc

SEQ ID NO: 181 - RNA, 23 nt, synthetic construct
  source 1..23: mol_type = other RNA
ttctttatagccagcacagacca

SEQ ID NO: 182 - RNA, 23 nt, synthetic construct
  source 1..23: mol_type = other RNA
ttggcattcttcaacactgctaa

SEQ ID NO: 183 - RNA, 23 nt, synthetic construct
  source 1..23: mol_type = other RNA
tatgagtgaccctccacacacgt

SEQ ID NO: 184 - RNA, 23 nt, synthetic construct
  source 1..23: mol_type = other RNA
ttcccttacaagcatcttttccc

SEQ ID NO: 185 - RNA, 23 nt, synthetic construct
  source 1..23: mol_type = other RNA
tggtgtgccactttcagatgttt

SEQ ID NO: 186 - RNA, 23 nt, synthetic construct
  source 1..23: mol_type = other RNA
ttctttatagccagcacagagca

SEQ ID NO: 187 - RNA, 23 nt, synthetic construct
  source 1..23: mol_type = other RNA
ttggcattcttcaacactgcaaa

SEQ ID NO: 188 - RNA, 23 nt, synthetic construct
  source 1..23: mol_type = other RNA
tactttcagatgttttaagaaga

SEQ ID NO: 189 - RNA, 23 nt, synthetic construct
  source 1..23: mol_type = other RNA
tagttggtataaattgtgctagt

SEQ ID NO: 190 - RNA, 23 nt, synthetic construct
  source 1..23: mol_type = other RNA
tccaccaaacgccacattccatt

SEQ ID NO: 191 - RNA, 23 nt, synthetic construct
  source 1..23: mol_type = other RNA
tttatttgatgaccacattggtt

SEQ ID NO: 192 - RNA, 23 nt, synthetic construct
  source 1..23: mol_type = other RNA
tatgagtgaccctccacacaggt

SEQ ID NO: 193 - RNA, 23 nt, synthetic construct
  source 1..23: mol_type = other RNA
tggtgtgccactttcagatgatt

SEQ ID NO: 194 - RNA, 23 nt, synthetic construct
  source 1..23: mol_type = other RNA
aacagttggtataaattgtggtt

SEQ ID NO: 195 - RNA, 23 nt, synthetic construct
  source 1..23: mol_type = other RNA
ttggtataaattgtgcttgtgtc

SEQ ID NO: 196 - RNA, 23 nt, synthetic construct
  source 1..23: mol_type = other RNA
tccaccaaacgccacattccttt

SEQ ID NO: 197 - RNA, 23 nt, synthetic construct
  source 1..23: mol_type = other RNA
aacagttggtataaattgtgctt

SEQ ID NO: 198 - RNA, 23 nt, synthetic construct
  source 1..23: mol_type = other RNA
ttttgttcctccaacaatgcgtg

SEQ ID NO: 199 - RNA, 23 nt, synthetic construct
  source 1..23: mol_type = other RNA
tagttggtataaattgtgcttgt

SEQ ID NO: 200 - RNA, 23 nt, synthetic construct
  source 1..23: mol_type = other RNA
ttggtataaattgtgcttgtctc

SEQ ID NO: 201 - RNA, 23 nt, synthetic construct
  source 1..23: mol_type = other RNA
aaagtcaactcccgggtaaaatt

SEQ ID NO: 202 - RNA, 23 nt, synthetic construct
  source 1..23: mol_type = other RNA
aaagtcaactcccgggtaaattt

SEQ ID NO: 203 - RNA, 23 nt, synthetic construct
  source 1..23: mol_type = other RNA
tggtataaattgtgcttgtgaca

SEQ ID NO: 204 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluorocytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluorouridine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatccaaaatattctacaaaa

SEQ ID NO: 205 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluorouridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylguanosine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluorocytidine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctggtcatcaaataagtgctt

SEQ ID NO: 206 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluorouridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylguanosine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluorocytidine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtggtcatcaaataagtgctt

SEQ ID NO: 207 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluoroguanosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluorouridine-3'-phosphate
  modified_base 14: mod_base = OTHER; note = 2'-O-methyluridine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catggactggattttagagaa

SEQ ID NO: 208 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accaaagtcgctgagtacata

SEQ ID NO: 209 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluoroguanosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluorouridine-3'-phosphate
  modified_base 14: mod_base = OTHER; note = 2'-O-methyluridine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatggactggattttagagaa

SEQ ID NO: 210 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tatgagaggagtcaattttaa

SEQ ID NO: 211 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatgagaggagtcaattttaa

SEQ ID NO: 212 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tccaaagtcgctgagtacata

SEQ ID NO: 213 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluorouridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluoroguanosine-3'-phosphate
  modified_base 14: mod_base = OTHER; note = 2'-O-methyluridine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attctacaaaaggtaaatatt

SEQ ID NO: 214 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluorouridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttctcacaaataaaagagat

SEQ ID NO: 215 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tatcaagattataaaataaca

SEQ ID NO: 216 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cttcttgaaagatagtgttaa

SEQ ID NO: 217 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methylguanosine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaatgtttgccaagagactta

SEQ ID NO: 218 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyluridine-3'-phosphate
  modified_base 5: mod_base = OTHER; note = 2'-deoxy-2'-fluorouridine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atattcctttggtaacaaata

SEQ ID NO: 219 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methylguanosine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluorocytidine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgtcatcaaataagtgcttga

SEQ ID NO: 220 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorocytidine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorocytidine-3'-phosphate
  modified_base 20: mod_base = OTHER; note = 2'-O-methylcytidine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcctgcaaaagaactttacct

SEQ ID NO: 221 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methylguanosine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caatgtttgccaagagactta

SEQ ID NO: 222 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluorouridine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agacacaagcacaatttataa

SEQ ID NO: 223 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylguanosine-3'-phosphate
  modified_base 5: mod_base = OTHER; note = 2'-deoxy-2'-fluorouridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgagtcacaaagaaatgttta

SEQ ID NO: 224 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorocytidine-3'-phosphate
  modified_base 4: mod_base = OTHER; note = 2'-O-methyluridine-3'-phosphate
  modified_base 5: mod_base = OTHER; note = 2'-deoxy-2'-fluorouridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-O-methylguanosine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluorouridine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atcttgaaagatagtgttaca

SEQ ID NO: 225 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluorouridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatgtggtcatcaaataagta

SEQ ID NO: 226 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methyladenosine-3'-phosphate
  modified_base 5: mod_base = OTHER; note = 2'-deoxy-2'-fluorocytidine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluorouridine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gttactctttgagattgtgta

SEQ ID NO: 227 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gttcttgaaagatagtgttaa

SEQ ID NO: 228 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyluridine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylguanosine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gactttggaggagaagaatta

SEQ ID NO: 229 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorocytidine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorocytidine-3'-phosphate
  modified_base 20: mod_base = OTHER; note = 2'-O-methylcytidine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acctgcaaaagaactttacct

SEQ ID NO: 230 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorocytidine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atcgagtcacaaagaaatgtt

SEQ ID NO: 231 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluorouridine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgacacaagcacaatttataa

SEQ ID NO: 232 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methylguanosine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluorocytidine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggtcatcaaataagtgcttga

SEQ ID NO: 233 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-deoxy-2'-fluorocytidine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methylcytidine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggtcatcaaataagtgctta

SEQ ID NO: 234 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorocytidine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agccagaaaagatatcaagat

SEQ ID NO: 235 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methyladenosine-3'-phosphate
  modified_base 5: mod_base = OTHER; note = 2'-deoxy-2'-fluorocytidine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluorouridine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cttactctttgagattgtgta

SEQ ID NO: 236 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluorouridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluoroguanosine-3'-phosphate
  modified_base 14: mod_base = OTHER; note = 2'-O-methyluridine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttctacaaaaggtaaatatt

SEQ ID NO: 237 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluoroguanosine-3'-phosphate
  modified_base 16: mod_base = OTHER; note = 2'-O-methylcytidine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacaatggaatgtggcgttta

SEQ ID NO: 238 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylcytidine-3'-phosphate
  modified_base 5: mod_base = OTHER; note = 2'-deoxy-2'-fluorouridine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluoroadenosine-3'-phosphate
  modified_base 14: mod_base = OTHER; note = 2'-O-methyluridine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttactctttgagattgtgtaa

SEQ ID NO: 239 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyluridine-3'-phosphate
  modified_base 5: mod_base = OTHER; note = 2'-deoxy-2'-fluorocytidine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methyluridine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tactctttgagattgtgtaaa

SEQ ID NO: 240 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorocytidine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgccagaaaagatatcaagat

SEQ ID NO: 241 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorocytidine-3'-phosphate
  modified_base 4: mod_base = OTHER; note = 2'-O-methyluridine-3'-phosphate
  modified_base 5: mod_base = OTHER; note = 2'-deoxy-2'-fluorouridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-O-methylguanosine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluorouridine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttcttgaaagatagtgttaca

SEQ ID NO: 242 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluoroguanosine-3'-phosphate
  modified_base 16: mod_base = OTHER; note = 2'-O-methylcytidine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacaatggaatgtggcgttta

SEQ ID NO: 243 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluoroguanosine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aataaaataacccaacggata

SEQ ID NO: 244 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cttaaaacatctgaaagtgga

SEQ ID NO: 245 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatcaagattataaaataaca

SEQ ID NO: 246 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorouridine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluoroguanosine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtaacgtggaatctggatta

SEQ ID NO: 247 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tataaaggagttgatatgaga

SEQ ID NO: 248 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylcytidine-3'-phosphate
  modified_base 5: mod_base = OTHER; note = 2'-deoxy-2'-fluorouridine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluoroadenosine-3'-phosphate
  modified_base 14: mod_base = OTHER; note = 2'-O-methyluridine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atactctttgagattgtgtaa

SEQ ID NO: 249 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aataaaggagttgatatgaga

SEQ ID NO: 250 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyluridine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylguanosine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cactttggaggagaagaatta

SEQ ID NO: 251 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluoroguanosine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tataaaataacccaacggata

SEQ ID NO: 252 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaatgtggtcatcaaataagt

SEQ ID NO: 253 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorouridine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluoroguanosine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtaacgtggaatctggatta

SEQ ID NO: 254 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorocytidine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttcgagtcacaaagaaatgtt

SEQ ID NO: 255 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyluridine-3'-phosphate
  modified_base 5: mod_base = OTHER; note = 2'-deoxy-2'-fluorouridine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttattcctttggtaacaaata

SEQ ID NO: 256 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methyluridine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorocytidine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acacaagcacaatttatacca

SEQ ID NO: 257 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methyluridine-3'-phosphate
  modified_base 15: mod_base = OTHER; note = 2'-deoxy-2'-fluorocytidine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluorocytidine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctggaatctggattctcacta

SEQ ID NO: 258 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gttaaaacatctgaaagtgga

SEQ ID NO: 259 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyluridine-3'-phosphate
  modified_base 5: mod_base = OTHER; note = 2'-deoxy-2'-fluorocytidine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methyluridine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aactctttgagattgtgtaaa

SEQ ID NO: 260 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyladenosine-3'-phosphate
  modified_base 5: mod_base = OTHER; note = 2'-deoxy-2'-fluorouridine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaatgtggtcatcaaataaa

SEQ ID NO: 261 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methyluridine-3'-phosphate
  modified_base 15: mod_base = OTHER; note = 2'-deoxy-2'-fluorocytidine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluorocytidine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtggaatctggattctcacta

SEQ ID NO: 262 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggcattgttggaggaacaaaa

SEQ ID NO: 263 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluorouridine-3'-phosphate
  modified_base 20: mod_base = OTHER; note = 2'-O-methylcytidine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttgttggaggaacaaactct

SEQ ID NO: 264 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylguanosine-3'-phosphate
  modified_base 5: mod_base = OTHER; note = 2'-deoxy-2'-fluorouridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggagtcacaaagaaatgttta

SEQ ID NO: 265 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluorouridine-3'-phosphate
  modified_base 20: mod_base = OTHER; note = 2'-O-methylcytidine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attgttggaggaacaaactct

SEQ ID NO: 266 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluorouridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tatgtggtcatcaaataagta

SEQ ID NO: 267 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyluridine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methylguanosine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caaaagatgcttgtaagggaa

SEQ ID NO: 268 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorocytidine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtctgtgctggctataaagaa

SEQ ID NO: 269 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methylcytidine-3'-phosphate
  modified_base 19: mod_base = OTHER; note = 2'-deoxy-2'-fluorocytidine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agcagtgttgaagaatgccaa

SEQ ID NO: 270 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgtgtggagggtcactcata

SEQ ID NO: 271 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyluridine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methylguanosine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaaaagatgcttgtaagggaa

SEQ ID NO: 272 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyluridine-3'-phosphate
  modified_base 5: mod_base = OTHER; note = 2'-deoxy-2'-fluorocytidine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylguanosine-3'-phosphate
  modified_base 15: mod_base = OTHER; note = 2'-deoxy-2'-fluorocytidine-3'-phosphate
  modified_base 16: mod_base = OTHER; note = 2'-O-methyladenosine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluorocytidine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acatctgaaagtggcacacca

SEQ ID NO: 273 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorocytidine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctctgtgctggctataaagaa

SEQ ID NO: 274 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methylcytidine-3'-phosphate
  modified_base 19: mod_base = OTHER; note = 2'-deoxy-2'-fluorocytidine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgcagtgttgaagaatgccaa

SEQ ID NO: 275 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorocytidine-3'-phosphate
  modified_base 4: mod_base = OTHER; note = 2'-O-methyluridine-3'-phosphate
  modified_base 5: mod_base = OTHER; note = 2'-deoxy-2'-fluorouridine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluorocytidine-3'-phosphate
  modified_base 14: mod_base = OTHER; note = 2'-O-methyluridine-3'-phosphate
  modified_base 15: mod_base = OTHER; note = 2'-deoxy-2'-fluoroguanosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttcttaaaacatctgaaagta

SEQ ID NO: 276 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluorocytidine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluorocytidine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tagcacaatttataccaacta

SEQ ID NO: 277 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methyluridine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggaatgtggcgtttggtgga

SEQ ID NO: 278 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyladenosine-3'-phosphate
  modified_base 5: mod_base = OTHER; note = 2'-deoxy-2'-fluorouridine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccaatgtggtcatcaaataaa

SEQ ID NO: 279 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgtgtggagggtcactcata

SEQ ID NO: 280 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyluridine-3'-phosphate
  modified_base 5: mod_base = OTHER; note = 2'-deoxy-2'-fluorocytidine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylguanosine-3'-phosphate
  modified_base 15: mod_base = OTHER; note = 2'-deoxy-2'-fluorocytidine-3'-phosphate
  modified_base 16: mod_base = OTHER; note = 2'-O-methyladenosine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluorocytidine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcatctgaaagtggcacacca

SEQ ID NO: 281 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-deoxy-2'-fluorocytidine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluorocytidine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccacaatttataccaactgtt

SEQ ID NO: 282 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluorouridine-3'-phosphate
  modified_base 14: mod_base = OTHER; note = 2'-O-methyluridine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluorocytidine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacaagcacaatttataccaa

SEQ ID NO: 283 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methyluridine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggaatgtggcgtttggtgga

SEQ ID NO: 284 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-deoxy-2'-fluorocytidine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluorocytidine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcacaatttataccaactgtt

SEQ ID NO: 285 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgcattgttggaggaacaaaa

SEQ ID NO: 286 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluorocytidine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluorocytidine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagcacaatttataccaacta

SEQ ID NO: 287 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluorouridine-3'-phosphate
  modified_base 14: mod_base = OTHER; note = 2'-O-methyluridine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluorocytidine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacaagcacaatttataccaa

SEQ ID NO: 288 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyluridine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttttacccgggagttgacttt

SEQ ID NO: 289 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyluridine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atttacccgggagttgacttt

SEQ ID NO: 290 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methyluridine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorocytidine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcacaagcacaatttatacca

SEQ ID NO: 291 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methyladenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttttgtagaatattttggatttc

SEQ ID NO: 292 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aagcacttatttgatgaccagat

SEQ ID NO: 293 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aagcacttatttgatgaccacat

SEQ ID NO: 294 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-O-methyladenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
ttctctaaaatccagtccatgta

SEQ ID NO: 295 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tatgtactcagcgactttggtgt

SEQ ID NO: 296 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-O-methyladenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyladenosine
ttctctaaaatccagtccatcta

SEQ ID NO: 297 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttaaaattgactcctctcatatc

SEQ ID NO: 298 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttaaaattgactcctctcatttc

SEQ ID NO: 299 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tatgtactcagcgactttggagt

SEQ ID NO: 300 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aatatttaccttttgtagaatat

SEQ ID NO: 301 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
atctcttttatttgtgagaaagg

SEQ ID NO: 302 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tgttattttataatcttgatatc

SEQ ID NO: 303 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
ttaacactatctttcaagaagca

SEQ ID NO: 304 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
taagtctcttggcaaacattcac

SEQ ID NO: 305 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
tatttgttaccaaaggaatattt

SEQ ID NO: 306 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
tcaagcacttatttgatgacgac

SEQ ID NO: 307 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methylguanosine-3'-phosphate
  modified_base 20: mod_base = OTHER; note = 2'-deoxy-2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
aggtaaagttcttttgcaggata

SEQ ID NO: 308 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
taagtctcttggcaaacattgac

SEQ ID NO: 309 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-deoxy-2'-fluorocytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
ttataaattgtgcttgtgtctcc

SEQ ID NO: 310 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-deoxy-2'-fluorocytidine-3'-phosphate
  modified_base 19: mod_base = OTHER; note = 2'-O-methyluridine-3'-phosphate
  modified_base 20: mod_base = OTHER; note = 2'-deoxy-2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
taaacatttctttgtgactcgat

SEQ ID NO: 311 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-deoxy-2'-fluoroadenosine-3'-phosphate
  modified_base 19: mod_base = OTHER; note = 2'-O-methylguanosine-3'-phosphate
  modified_base 20: mod_base = OTHER; note = 2'-deoxy-2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
tgtaacactatctttcaagatgc

SEQ ID NO: 312 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
tacttatttgatgaccacattgc

SEQ ID NO: 313 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-deoxy-2'-fluorouridine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
tacacaatctcaaagagtaacca

SEQ ID NO: 314 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
ttaacactatctttcaagaacca

SEQ ID NO: 315 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluoroadenosine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
taattcttctcctccaaagtcaa

SEQ ID NO: 316 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methylguanosine-3'-phosphate
  modified_base 20: mod_base = OTHER; note = 2'-deoxy-2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine
aggtaaagttcttttgcaggtta

SEQ ID NO: 317 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylguanosine-3'-phosphate
  modified_base 20: mod_base = OTHER; note = 2'-deoxy-2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
aacatttctttgtgactcgattt

SEQ ID NO: 318 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
ttataaattgtgcttgtgtcacc

SEQ ID NO: 319 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
tcaagcacttatttgatgaccac

SEQ ID NO: 320 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroguanosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-deoxy-2'-fluoroadenosine-3'-phosphate
  modified_base 19: mod_base = OTHER; note = 2'-O-methylcytidine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
taagcacttatttgatgaccaca

SEQ ID NO: 321 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methylguanosine-3'-phosphate
  modified_base 20: mod_base = OTHER; note = 2'-deoxy-2'-fluorocytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
atcttgatatcttttctggcttt

SEQ ID NO: 322 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-deoxy-2'-fluorouridine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
tacacaatctcaaagagtaagca

SEQ ID NO: 323 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aatatttaccttttgtagaaaat

SEQ ID NO: 324 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
taaacgccacattccattgtgtt

SEQ ID NO: 325 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
ttacacaatctcaaagagtaacc

SEQ ID NO: 326 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-deoxy-2'-fluoroadenosine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
tttacacaatctcaaagagtaac

SEQ ID NO: 327 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methylguanosine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
atcttgatatcttttctggcatt

SEQ ID NO: 328 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-deoxy-2'-fluoroadenosine-3'-phosphate
  modified_base 19: mod_base = OTHER; note = 2'-O-methylguanosine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
tgtaacactatctttcaagaagc

SEQ ID NO: 329 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
taaacgccacattccattgtctt

SEQ ID NO: 330 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methylcytidine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluoroguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyluridine
tatccgttgggttattttattat

SEQ ID NO: 331 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
tccactttcagatgttttaagaa

SEQ ID NO: 332 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tgttattttataatcttgatttc

SEQ ID NO: 333 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methylcytidine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methyladenosine-3'-phosphate
  modified_base 20: mod_base = OTHER; note = 2'-deoxy-2'-fluorocytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
taatccagattccacgttactca

SEQ ID NO: 334 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
tctcatatcaactcctttataaa

SEQ ID NO: 335 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-deoxy-2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
ttacacaatctcaaagagtatcc

SEQ ID NO: 336 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
tctcatatcaactcctttattaa

SEQ ID NO: 337 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluoroadenosine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
taattcttctcctccaaagtgaa

SEQ ID NO: 338 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methylcytidine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluoroguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
tatccgttgggttattttataat

SEQ ID NO: 339 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluorouridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine
acttatttgatgaccacattcct

SEQ ID NO: 340 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methylcytidine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methyladenosine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
taatccagattccacgttacaca

SEQ ID NO: 341 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylguanosine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
aacatttctttgtgactcgaatt

SEQ ID NO: 342 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
tatttgttaccaaaggaataatt

SEQ ID NO: 343 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
tggtataaattgtgcttgtgtca

SEQ ID NO: 344 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tagtgagaatccagattccaggt

SEQ ID NO: 345 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
tccactttcagatgttttaacaa

SEQ ID NO: 346 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-deoxy-2'-fluoroadenosine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
tttacacaatctcaaagagttac

SEQ ID NO: 347 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-deoxy-2'-fluorouridine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
tttatttgatgaccacattgctt

SEQ ID NO: 348 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tagtgagaatccagattccacgt

SEQ ID NO: 349 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
ttttgttcctccaacaatgcctg

SEQ ID NO: 350 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
agagtttgttcctccaacaaagc

SEQ ID NO: 351 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-deoxy-2'-fluorocytidine-3'-phosphate
  modified_base 19: mod_base = OTHER; note = 2'-O-methyluridine-3'-phosphate
  modified_base 20: mod_base = OTHER; note = 2'-deoxy-2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
taaacatttctttgtgactccat

SEQ ID NO: 352 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
agagtttgttcctccaacaatgc

SEQ ID NO: 353 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
tacttatttgatgaccacatagc

SEQ ID NO: 354 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluorocytidine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methyluridine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
ttcccttacaagcatcttttgcc

SEQ ID NO: 355 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluoroguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methylguanosine-3'-phosphate
  modified_base 20: mod_base = OTHER; note = 2'-deoxy-2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
ttctttatagccagcacagacca

SEQ ID NO: 356 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-deoxy-2'-fluoroguanosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorocytidine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
ttggcattcttcaacactgctaa

SEQ ID NO: 357 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tatgagtgaccctccacacacgt

SEQ ID NO: 358 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluorocytidine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methyluridine-3'-phosphate
  modified_base 20: mod_base = OTHER; note = 2'-deoxy-2'-fluorouridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
ttcccttacaagcatcttttccc

SEQ ID NO: 359 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
tggtgtgccactttcagatgttt

SEQ ID NO: 360 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluoroguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methylguanosine-3'-phosphate
  modified_base 20: mod_base = OTHER; note = 2'-deoxy-2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
ttctttatagccagcacagagca

SEQ ID NO: 361 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-deoxy-2'-fluoroguanosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
ttggcattcttcaacactgcaaa

SEQ ID NO: 362 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-O-methylguanosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-deoxy-2'-fluoroadenosine-3'-phosphate
  modified_base 19: mod_base = OTHER; note = 2'-O-methylguanosine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
tactttcagatgttttaagaaga

SEQ ID NO: 363 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tagttggtataaattgtgctagt

SEQ ID NO: 364 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methylcytidine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
tccaccaaacgccacattccatt

SEQ ID NO: 365 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-deoxy-2'-fluorouridine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
tttatttgatgaccacattggtt

SEQ ID NO: 366 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tatgagtgaccctccacacaggt

SEQ ID NO: 367 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
tggtgtgccactttcagatgatt

SEQ ID NO: 368 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
aacagttggtataaattgtggtt

SEQ ID NO: 369 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-O-methyladenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttggtataaattgtgcttgtgtc

SEQ ID NO: 370 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methylcytidine-3'-phosphate
  modified_base 20: mod_base = OTHER; note = 2'-deoxy-2'-fluorocytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
tccaccaaacgccacattccttt

SEQ ID NO: 371 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
aacagttggtataaattgtgctt

SEQ ID NO: 372 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
ttttgttcctccaacaatgcgtg

SEQ ID NO: 373 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tagttggtataaattgtgcttgt

SEQ ID NO: 374 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-O-methyladenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttggtataaattgtgcttgtctc

SEQ ID NO: 375 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
aaagtcaactcccgggtaaaatt

SEQ ID NO: 376 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
aaagtcaactcccgggtaaattt

SEQ ID NO: 377 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
tggtataaattgtgcttgtgaca

SEQ ID NO: 378 - RNA, 21 nt, synthetic construct
  source 1..21: mol_type = other RNA
ggtgagcttggagtcaacact

SEQ ID NO: 379 - RNA, 21 nt, synthetic construct
  source 1..21: mol_type = other RNA
gagcttggagtcaacacttta

SEQ ID NO: 380 - RNA, 21 nt, synthetic construct
  source 1..21: mol_type = other RNA
cttggagtcaacactttcgat

SEQ ID NO: 381 - RNA, 21 nt, synthetic construct
  source 1..21: mol_type = other RNA
ttggagtcaacactttcgatt

SEQ ID NO: 382 - RNA, 21 nt, synthetic construct
  source 1..21: mol_type = other RNA
aacactttcgattccacctta

SEQ ID NO: 383 - RNA, 21 nt, synthetic construct
  source 1..21: mol_type = other RNA
aggagcataagtacaaagcta

SEQ ID NO: 384 - RNA, 21 nt, synthetic construct
  source 1..21: mol_type = other RNA
gagcataagtacaaagctgaa

SEQ ID NO: 385 - RNA, 21 nt, synthetic construct
  source 1..21: mol_type = other RNA
taagtacaaagctgaagagca

SEQ ID NO: 386 - RNA, 21 nt, synthetic construct
  source 1..21: mol_type = other RNA
aagtacaaagctgaagagcaa

SEQ ID NO: 387 - RNA, 21 nt, synthetic construct
  source 1..21: mol_type = other RNA
taccacaaatgtacccacaaa

SEQ ID NO: 388 - RNA, 21 nt, synthetic construct
  source 1..21: mol_type = other RNA
ccacaaatgtacccacaagga

SEQ ID NO: 389 - RNA, 21 nt, synthetic construct
  source 1..21: mol_type = other RNA
tactgtttggagcccaagaaa

SEQ ID NO: 390 - RNA, 21 nt, synthetic construct
  source 1..21: mol_type = other RNA
actgtttggagcccaagaaaa

SEQ ID NO: 391 - RNA, 21 nt, synthetic construct
  source 1..21: mol_type = other RNA
ctgtttggagcccaagaaagt

SEQ ID NO: 392 - RNA, 21 nt, synthetic construct
  source 1..21: mol_type = other RNA
ggagcccaagaaagtgaaaga

SEQ ID NO: 393 - RNA, 21 nt, synthetic construct
  source 1..21: mol_type = other RNA
gagcccaagaaagtgaaagaa

SEQ ID NO: 394 - RNA, 21 nt, synthetic construct
  source 1..21: mol_type = other RNA
agcccaagaaagtgaaagaca

SEQ ID NO: 395 - RNA, 21 nt, synthetic construct
  source 1..21: mol_type = other RNA
gcccaagaaagtgaaagacca

SEQ ID NO: 396 - RNA, 21 nt, synthetic construct
  source 1..21: mol_type = other RNA
cccaagaaagtgaaagaccaa

SEQ ID NO: 397 - RNA, 21 nt, synthetic construct
  source 1..21: mol_type = other RNA
caagaaagtgaaagaccatta

SEQ ID NO: 398 - RNA, 21 nt, synthetic construct
  source 1..21: mol_type = other RNA
gaaagtgaaagaccactgcaa

SEQ ID NO: 399 - RNA, 21 nt, synthetic construct
  source 1..21: mol_type = other RNA
aaagtgaaagaccactgcaga

SEQ ID NO: 400 - RNA, 21 nt, synthetic construct
  source 1..21: mol_type = other RNA
tcactggaaaccactgccaga

SEQ ID NO: 401 - RNA, 21 nt, synthetic construct
  source 1..21: mol_type = other RNA
actgccagaaagagaagtgct

SEQ ID NO: 402 - RNA, 21 nt, synthetic construct
  source 1..21: mol_type = other RNA
ctgccagaaagagaagtgctt

SEQ ID NO: 403 - RNA, 21 nt, synthetic construct
  source 1..21: mol_type = other RNA
cagaaagagaagtgctttgaa

SEQ ID NO: 404 - RNA, 21 nt, synthetic construct
  source 1..21: mol_type = other RNA
agaaagagaagtgctttgaga

SEQ ID NO: 405 - RNA, 21 nt, synthetic construct
  source 1..21: mol_type = other RNA
agtgctttgagcctcagctta

SEQ ID NO: 406 - RNA, 21 nt, synthetic construct
  source 1..21: mol_type = other RNA
ttccacaagaatgagatatga

SEQ ID NO: 407 - RNA, 21 nt, synthetic construct
  source 1..21: mol_type = other RNA
tccacaagaatgagatatggt

SEQ ID NO: 408 - RNA, 21 nt, synthetic construct
  source 1..21: mol_type = other RNA
ccacaagaatgagatatggta

SEQ ID NO: 409 - RNA, 21 nt, synthetic construct
  source 1..21: mol_type = other RNA
aagaatgagatatggtataga

SEQ ID NO: 410 - RNA, 21 nt, synthetic construct
  source 1..21: mol_type = other RNA
tggtatagaactgagcaagca

SEQ ID NO: 411 - RNA, 21 nt, synthetic construct
  source 1..21: mol_type = other RNA
gtatagaactgagcaagcaga

SEQ ID NO: 412 - RNA, 21 nt, synthetic construct
  source 1..21: mol_type = other RNA
atagaactgagcaagcagcta

SEQ ID NO: 413 - RNA, 21 nt, synthetic construct
  source 1..21: mol_type = other RNA
ccagatgccagtgcaagggta

SEQ ID NO: 414 - RNA, 21 nt, synthetic construct
  source 1..21: mol_type = other RNA
gccagtgcaagggtcctgata

SEQ ID NO: 415 - RNA, 21 nt, synthetic construct
  source 1..21: mol_type = other RNA
cagtgcaagggtcctgatgca

SEQ ID NO: 416 - RNA, 21 nt, synthetic construct
  source 1..21: mol_type = other RNA
accaaggcaagctgctatgat

SEQ ID NO: 417 - RNA, 21 nt, synthetic construct
  source 1..21: mol_type = other RNA
ccaaggcaagctgctatgata

SEQ ID NO: 418 - RNA, 21 nt, synthetic construct
  source 1..21: mol_type = other RNA
aggcttcatgtcccactcata

SEQ ID NO: 419 - RNA, 21 nt, synthetic construct
  source 1..21: mol_type = other RNA
ggctccgcaagagtctgtctt

SEQ ID NO: 420 - RNA, 21 nt, synthetic construct
  source 1..21: mol_type = other RNA
gctccgcaagagtctgtctta

SEQ ID NO: 421 - RNA, 21 nt, synthetic construct
  source 1..21: mol_type = other RNA
ccgcaagagtctgtcttcgat

SEQ ID NO: 422 - RNA, 21 nt, synthetic construct
  source 1..21: mol_type = other RNA
gttcgagggggctgaagaata

SEQ ID NO: 423 - RNA, 21 nt, synthetic construct
  source 1..21: mol_type = other RNA
ggaaggcaagattgtgtccca

SEQ ID NO: 424 - RNA, 21 nt, synthetic construct
  source 1..21: mol_type = other RNA
aggcaagattgtgtcccatta

SEQ ID NO: 425 - RNA, 21 nt, synthetic construct
  source 1..21: mol_type = other RNA
aactcaataaagtgctttgaa

SEQ ID NO: 426 - RNA, 21 nt, synthetic construct
  source 1..21: mol_type = other RNA
aataaagtgctttgaaaacgt

SEQ ID NO: 427 - RNA, 21 nt, synthetic construct
  source 1..21: mol_type = other RNA
agtgctttgaaaatgctgaga

SEQ ID NO: 428 - RNA, 23 nt, synthetic construct
  source 1..23: mol_type = other RNA
agtgttgactccaagctcaccag

SEQ ID NO: 429 - RNA, 23 nt, synthetic construct
  source 1..23: mol_type = other RNA
taaagtgttgactccaagctcac

SEQ ID NO: 430 - RNA, 23 nt, synthetic construct
  source 1..23: mol_type = other RNA
atcgaaagtgttgactccaagct

SEQ ID NO: 431 - RNA, 23 nt, synthetic construct
  source 1..23: mol_type = other RNA
aatcgaaagtgttgactccaagc

SEQ ID NO: 432 - RNA, 23 nt, synthetic construct
  source 1..23: mol_type = other RNA
taaggtggaatcgaaagtgttga

SEQ ID NO: 433 - RNA, 23 nt, synthetic construct
  source 1..23: mol_type = other RNA
tagctttgtacttatgctccttg

SEQ ID NO: 434 - RNA, 23 nt, synthetic construct
  source 1..23: mol_type = other RNA
ttcagctttgtacttatgctcct

SEQ ID NO: 435 - RNA, 23 nt, synthetic construct
  source 1..23: mol_type = other RNA
tgctcttcagctttgtacttatg

SEQ ID NO: 436 - RNA, 23 nt, synthetic construct
  source 1..23: mol_type = other RNA
ttgctcttcagctttgtacttat

SEQ ID NO: 437 - RNA, 23 nt, synthetic construct
  source 1..23: mol_type = other RNA
tttgtgggtacatttgtggtaca

SEQ ID NO: 438 - RNA, 23 nt, synthetic construct
  source 1..23: mol_type = other RNA
tccttgtgggtacatttgtggta

SEQ ID NO: 439 - RNA, 23 nt, synthetic construct
  source 1..23: mol_type = other RNA
tttcttgggctccaaacagtatc

SEQ ID NO: 440 - RNA, 23 nt, synthetic construct
  source 1..23: mol_type = other RNA
ttttcttgggctccaaacagtat

SEQ ID NO: 441 - RNA, 23 nt, synthetic construct
  source 1..23: mol_type = other RNA
actttcttgggctccaaacagta

SEQ ID NO: 442 - RNA, 23 nt, synthetic construct
  source 1..23: mol_type = other RNA
tctttcactttcttgggctccaa

SEQ ID NO: 443 - RNA, 23 nt, synthetic construct
  source 1..23: mol_type = other RNA
ttctttcactttcttgggctcca

SEQ ID NO: 444 - RNA, 23 nt, synthetic construct
  source 1..23: mol_type = other RNA
tgtctttcactttcttgggctcc

SEQ ID NO: 445 - RNA, 23 nt, synthetic construct
  source 1..23: mol_type = other RNA
tggtctttcactttcttgggctc

SEQ ID NO: 446 - RNA, 23 nt, synthetic construct
  source 1..23: mol_type = other RNA
ttggtctttcactttcttgggct

SEQ ID NO: 447 - RNA, 23 nt, synthetic construct
  source 1..23: mol_type = other RNA
taatggtctttcactttcttggg

SEQ ID NO: 448 - RNA, 23 nt, synthetic construct
  source 1..23: mol_type = other RNA
ttgcagtggtctttcactttctt

SEQ ID NO: 449 - RNA, 23 nt, synthetic construct
  source 1..23: mol_type = other RNA
tctgcagtggtctttcactttct

SEQ ID NO: 450 - RNA, 23 nt, synthetic construct
  source 1..23: mol_type = other RNA
tctggcagtggtttccagtgagg

SEQ ID NO: 451 - RNA, 23 nt, synthetic construct
  source 1..23: mol_type = other RNA
agcacttctctttctggcagtgg

SEQ ID NO: 452 - RNA, 23 nt, synthetic construct
  source 1..23: mol_type = other RNA
aagcacttctctttctggcagtg

SEQ ID NO: 453 - RNA, 23 nt, synthetic construct
  source 1..23: mol_type = other RNA
ttcaaagcacttctctttctggc

SEQ ID NO: 454 - RNA, 23 nt, synthetic construct
  source 1..23: mol_type = other RNA
tctcaaagcacttctctttctgg

SEQ ID NO: 455 - RNA, 23 nt, synthetic construct
  source 1..23: mol_type = other RNA
taagctgaggctcaaagcacttc

SEQ ID NO: 456 - RNA, 23 nt, synthetic construct
  source 1..23: mol_type = other RNA
tcatatctcattcttgtggaaaa

SEQ ID NO: 457 - RNA, 23 nt, synthetic construct
  source 1..23: mol_type = other RNA
accatatctcattcttgtggaaa

SEQ ID NO: 458 - RNA, 23 nt, synthetic construct
  source 1..23: mol_type = other RNA
taccatatctcattcttgtggaa

SEQ ID NO: 459 - RNA, 23 nt, synthetic construct
  source 1..23: mol_type = other RNA
tctataccatatctcattcttgt

SEQ ID NO: 460 - RNA, 23 nt, synthetic construct
  source 1..23: mol_type = other RNA
tgcttgctcagttctataccata

SEQ ID NO: 461 - RNA, 23 nt, synthetic construct
  source 1..23: mol_type = other RNA
tctgcttgctcagttctatacca

SEQ ID NO: 462 - RNA, 23 nt, synthetic construct
  source 1..23: mol_type = other RNA
tagctgcttgctcagttctatac

SEQ ID NO: 463 - RNA, 23 nt, synthetic construct
  source 1..23: mol_type = other RNA
tacccttgcactggcatctggcc

SEQ ID NO: 464 - RNA, 23 nt, synthetic construct
  source 1..23: mol_type = other RNA
tatcaggacccttgcactggcat

SEQ ID NO: 465 - RNA, 23 nt, synthetic construct
  source 1..23: mol_type = other RNA
tgcatcaggacccttgcactggc

SEQ ID NO: 466 - RNA, 23 nt, synthetic construct
  source 1..23: mol_type = other RNA
atcatagcagcttgccttggtgt

SEQ ID NO: 467 - RNA, 23 nt, synthetic construct
  source 1..23: mol_type = other RNA
tatcatagcagcttgccttggtg

SEQ ID NO: 468 - RNA, 23 nt, synthetic construct
  source 1..23: mol_type = other RNA
tatgagtgggacatgaagcctag

SEQ ID NO: 469 - RNA, 23 nt, synthetic construct
  source 1..23: mol_type = other RNA
aagacagactcttgcggagccgc

SEQ ID NO: 470 - RNA, 23 nt, synthetic construct
  source 1..23: mol_type = other RNA
taagacagactcttgcggagccg

SEQ ID NO: 471 - RNA, 23 nt, synthetic construct
  source 1..23: mol_type = other RNA
atcgaagacagactcttgcggag

SEQ ID NO: 472 - RNA, 23 nt, synthetic construct
  source 1..23: mol_type = other RNA
tattcttcagccccctcgaactg

SEQ ID NO: 473 - RNA, 23 nt, synthetic construct
  source 1..23: mol_type = other RNA
tgggacacaatcttgccttccat

SEQ ID NO: 474 - RNA, 23 nt, synthetic construct
  source 1..23: mol_type = other RNA
taatgggacacaatcttgccttc

SEQ ID NO: 475 - RNA, 23 nt, synthetic construct
  source 1..23: mol_type = other RNA
ttcaaagcactttattgagtttc

SEQ ID NO: 476 - RNA, 23 nt, synthetic construct
  source 1..23: mol_type = other RNA
acgttttcaaagcactttattga

SEQ ID NO: 477 - RNA, 23 nt, synthetic construct
  source 1..23: mol_type = other RNA
tctcagcattttcaaagcacttt

SEQ ID NO: 478 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyluridine-3'-phosphate
  modified_base 15: mod_base = OTHER; note = 2'-deoxy-2'-fluorocytidine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methylcytidine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggtgagcttggagtcaacact

SEQ ID NO: 479 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylcytidine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluorocytidine-3'-phosphate
  modified_base 16: mod_base = OTHER; note = 2'-O-methyladenosine-3'-phosphate
  modified_base 17: mod_base = OTHER; note = 2'-deoxy-2'-fluorocytidine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagcttggagtcaacacttta

SEQ ID NO: 480 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluoroguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methylcytidine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cttggagtcaacactttcgat

SEQ ID NO: 481 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-deoxy-2'-fluorocytidine-3'-phosphate
  modified_base 14: mod_base = OTHER; note = 2'-O-methyluridine-3'-phosphate
  modified_base 15: mod_base = OTHER; note = 2'-deoxy-2'-fluorouridine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttggagtcaacactttcgatt

SEQ ID NO: 482 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluorocytidine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluorouridine-3'-phosphate
  modified_base 14: mod_base = OTHER; note = 2'-O-methylcytidine-3'-phosphate
  modified_base 15: mod_base = OTHER; note = 2'-deoxy-2'-fluorocytidine-3'-phosphate
  modified_base 16: mod_base = OTHER; note = 2'-O-methyladenosine-3'-phosphate
  modified_base 17: mod_base = OTHER; note = 2'-deoxy-2'-fluorocytidine-3'-phosphate
  modified_base 18: mod_base = OTHER; note = 2'-O-methylcytidine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacactttcgattccacctta

SEQ ID NO: 483 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methylguanosine-3'-phosphate
  modified_base 19: mod_base = OTHER; note = 2'-deoxy-2'-fluorocytidine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggagcataagtacaaagcta

SEQ ID NO: 484 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylguanosine-3'-phosphate
  modified_base 17: mod_base = OTHER; note = 2'-deoxy-2'-fluorocytidine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagcataagtacaaagctgaa

SEQ ID NO: 485 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylguanosine-3'-phosphate
  modified_base 5: mod_base = OTHER; note = 2'-deoxy-2'-fluorouridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taagtacaaagctgaagagca

SEQ ID NO: 486 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylguanosine-3'-phosphate
  modified_base 17: mod_base = OTHER; note = 2'-deoxy-2'-fluoroadenosine-3'-phosphate
  modified_base 18: mod_base = OTHER; note = 2'-O-methylguanosine-3'-phosphate
  modified_base 19: mod_base = OTHER; note = 2'-deoxy-2'-fluorocytidine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagtacaaagctgaagagcaa

SEQ ID NO: 487 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-O-methylcytidine-3'-phosphate
  modified_base 15: mod_base = OTHER; note = 2'-deoxy-2'-fluorocytidine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taccacaaatgtacccacaaa

SEQ ID NO: 488 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-deoxy-2'-fluorocytidine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccacaaatgtacccacaagga

SEQ ID NO: 489 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluorocytidine-3'-phosphate
  modified_base 14: mod_base = OTHER; note = 2'-O-methylcytidine-3'-phosphate
  modified_base 15: mod_base = OTHER; note = 2'-deoxy-2'-fluorocytidine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tactgtttggagcccaagaaa

SEQ ID NO: 490 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-deoxy-2'-fluorocytidine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actgtttggagcccaagaaaa

SEQ ID NO: 491 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylguanosine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgtttggagcccaagaaagt

SEQ ID NO: 492 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylguanosine-3'-phosphate
  modified_base 5: mod_base = OTHER; note = 2'-deoxy-2'-fluorocytidine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methylguanosine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggagcccaagaaagtgaaaga

SEQ ID NO: 493 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylcytidine-3'-phosphate
  modified_base 5: mod_base = OTHER; note = 2'-deoxy-2'-fluorocytidine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyluridine-3'-phosphate
  modified_base 15: mod_base = OTHER; note = 2'-deoxy-2'-fluoroguanosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagcccaagaaagtgaaagaa

SEQ ID NO: 494 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorocytidine-3'-phosphate
  modified_base 4: mod_base = OTHER; note = 2'-O-methylcytidine-3'-phosphate
  modified_base 5: mod_base = OTHER; note = 2'-deoxy-2'-fluorocytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agcccaagaaagtgaaagaca

SEQ ID NO: 495 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorocytidine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methyladenosine-3'-phosphate
  modified_base 19: mod_base = OTHER; note = 2'-deoxy-2'-fluorocytidine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcccaagaaagtgaaagacca

SEQ ID NO: 496 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylguanosine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluorocytidine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cccaagaaagtgaaagaccaa

SEQ ID NO: 497 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caagaaagtgaaagaccatta

SEQ ID NO: 498 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluorocytidine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluorocytidine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaaagtgaaagaccattgcaa

SEQ ID NO: 499 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylguanosine-3'-phosphate
  modified_base 5: mod_base = OTHER; note = 2'-deoxy-2'-fluorouridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluorouridine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaagtgaaagaccattgcaga

SEQ ID NO: 500 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylcytidine-3'-phosphate
  modified_base 5: mod_base = OTHER; note = 2'-deoxy-2'-fluorouridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluorocytidine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcactggaaaccactgccaga

SEQ ID NO: 501 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluorocytidine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluoroadenosine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methylcytidine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actgccagaaagagaagtgct

SEQ ID NO: 502 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylcytidine-3'-phosphate
  modified_base 5: mod_base = OTHER; note = 2'-deoxy-2'-fluorocytidine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylguanosine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluorocytidine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgccagaaagagaagtgctt

SEQ ID NO: 503 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluorocytidine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagaaagagaagtgctttgaa

SEQ ID NO: 504 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agaaagagaagtgctttgaga

SEQ ID NO: 505 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluorocytidine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-deoxy-2'-fluorocytidine-3'-phosphate
  modified_base 14: mod_base = OTHER; note = 2'-O-methyluridine-3'-phosphate
  modified_base 15: mod_base = OTHER; note = 2'-deoxy-2'-fluorocytidine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methylcytidine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtgctttgagcctcagctta

SEQ ID NO: 506 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorocytidine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyladenosine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttccacaagaatgagatatga

SEQ ID NO: 507 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluorocytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-deoxy-2'-fluoroadenosine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methylguanosine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tccacaagaatgagatatggt

SEQ ID NO: 508 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccacaagaatgagatatggta

SEQ ID NO: 509 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagaatgagatatggtataga

SEQ ID NO: 510 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggtatagaactgagcaagca

SEQ ID NO: 511 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtatagaactgagcaagcaga

SEQ ID NO: 512 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methylguanosine-3'-phosphate
  modified_base 19: mod_base = OTHER; note = 2'-deoxy-2'-fluorocytidine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atagaactgagcaagcagcta

SEQ ID NO: 513 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methylguanosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccagatgccagtgcaagggta

SEQ ID NO: 514 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-deoxy-2'-fluoroguanosine-3'-phosphate
  modified_base 14: mod_base = OTHER; note = 2'-O-methyluridine-3'-phosphate
  modified_base 15: mod_base = OTHER; note = 2'-deoxy-2'-fluorocytidine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gccagtgcaagggtcctgata

SEQ ID NO: 515 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluorocytidine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagtgcaagggtcctgatgca

SEQ ID NO: 516 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluorocytidine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accaaggcaagctgctatgat

SEQ ID NO: 517 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccaaggcaagctgctatgata

SEQ ID NO: 518 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylcytidine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluorocytidine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggcttcatgtcccactcata

SEQ ID NO: 519 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyluridine-3'-phosphate
  modified_base 5: mod_base = OTHER; note = 2'-deoxy-2'-fluorocytidine-3'-phosphate
  modified_base 6: mod_base = OTHER; note = 2'-O-methylcytidine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyluridine-3'-phosphate
  modified_base 15: mod_base = OTHER; note = 2'-deoxy-2'-fluorocytidine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluorocytidine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggctccgcaagagtctgtctt

SEQ ID NO: 520 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluorocytidine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluorouridine-3'-phosphate
  modified_base 18: mod_base = OTHER; note = 2'-O-methylcytidine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctccgcaagagtctgtctta

SEQ ID NO: 521 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyluridine-3'-phosphate
  modified_base 15: mod_base = OTHER; note = 2'-deoxy-2'-fluorocytidine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methylcytidine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccgcaagagtctgtcttcgat

SEQ ID NO: 522 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluoroguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gttcgagggggctgaagaata

SEQ ID NO: 523 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluorouridine-3'-phosphate
  modified_base 18: mod_base = OTHER; note = 2'-O-methylcytidine-3'-phosphate
  modified_base 19: mod_base = OTHER; note = 2'-deoxy-2'-fluorocytidine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggaaggcaagattgtgtccca

SEQ ID NO: 524 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyluridine-3'-phosphate
  modified_base 15: mod_base = OTHER; note = 2'-deoxy-2'-fluorocytidine-3'-phosphate
  modified_base 16: mod_base = OTHER; note = 2'-O-methylcytidine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggcaagattgtgtcccatta

SEQ ID NO: 525 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyluridine-3'-phosphate
  modified_base 5: mod_base = OTHER; note = 2'-deoxy-2'-fluorocytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluorocytidine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aactcaataaagtgctttgaa

SEQ ID NO: 526 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluorocytidine-3'-phosphate
  modified_base 20: mod_base = OTHER; note = 2'-O-methylguanosine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aataaagtgctttgaaaacgt

SEQ ID NO: 527 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluorocytidine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methyluridine-3'-phosphate
  modified_base 15: mod_base = OTHER; note = 2'-deoxy-2'-fluoroguanosine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtgctttgaaaatgctgaga

SEQ ID NO: 528 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
agtgttgactccaagctcaccag

SEQ ID NO: 529 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
taaagtgttgactccaagctcac

SEQ ID NO: 530 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
atcgaaagtgttgactccaagct

SEQ ID NO: 531 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
aatcgaaagtgttgactccaagc

SEQ ID NO: 532 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroguanosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluoroguanosine-3'-phosphate
  modified_base 9: mod_base = OTHER; note = 2'-O-methyladenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
taaggtggaatcgaaagtgttga

SEQ ID NO: 533 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-deoxy-2'-fluorocytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylcytidine-3'-phosphate
  modified_base 20: mod_base = OTHER; note = 2'-deoxy-2'-fluorocytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
tagctttgtacttatgctccttg

SEQ ID NO: 534 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine
ttcagctttgtacttatgctcct

SEQ ID NO: 535 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluoroguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-deoxy-2'-fluorocytidine-3'-phosphate
  modified_base 19: mod_base = OTHER; note = 2'-O-methyluridine-3'-phosphate
  modified_base 20: mod_base = OTHER; note = 2'-deoxy-2'-fluorouridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
tgctcttcagctttgtacttatg

SEQ ID NO: 536 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-deoxy-2'-fluorocytidine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyluridine
ttgctcttcagctttgtacttat

SEQ ID NO: 537 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methylguanosine-3'-phosphate
  modified_base 8: mod_base = OTHER; note = 2'-deoxy-2'-fluoroguanosine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
tttgtgggtacatttgtggtaca

SEQ ID NO: 538 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methylguanosine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
tccttgtgggtacatttgtggta

SEQ ID NO: 539 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluoroguanosine-3'-phosphate
  modified_base 9: mod_base = OTHER; note = 2'-O-methylguanosine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tttcttgggctccaaacagtatc

SEQ ID NO: 540 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methylguanosine-3'-phosphate
  modified_base 10: mod_base = OTHER; note = 2'-deoxy-2'-fluoroguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyluridine
ttttcttgggctccaaacagtat

SEQ ID NO: 541 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluoroguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluoroadenosine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
actttcttgggctccaaacagta

SEQ ID NO: 542 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-deoxy-2'-fluorocytidine-3'-phosphate
  modified_base 19: mod_base = OTHER; note = 2'-O-methyluridine-3'-phosphate
  modified_base 20: mod_base = OTHER; note = 2'-deoxy-2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
tctttcactttcttgggctccaa

SEQ ID NO: 543 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
ttctttcactttcttgggctcca

SEQ ID NO: 544 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-deoxy-2'-fluoroguanosine-3'-phosphate
  modified_base 19: mod_base = OTHER; note = 2'-O-methylguanosine-3'-phosphate
  modified_base 20: mod_base = OTHER; note = 2'-deoxy-2'-fluorocytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
tgtctttcactttcttgggctcc

SEQ ID NO: 545 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-deoxy-2'-fluorouridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methylguanosine-3'-phosphate
  modified_base 20: mod_base = OTHER; note = 2'-deoxy-2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tggtctttcactttcttgggctc

SEQ ID NO: 546 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluorocytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
ttggtctttcactttcttgggct

SEQ ID NO: 547 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methyluridine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
taatggtctttcactttcttggg

SEQ ID NO: 548 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methyluridine-3'-phosphate
  modified_base 20: mod_base = OTHER; note = 2'-deoxy-2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttgcaatggtctttcactttctt

SEQ ID NO: 549 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-deoxy-2'-fluorocytidine-3'-phosphate
  modified_base 19: mod_base = OTHER; note = 2'-O-methyluridine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
tctgcaatggtctttcactttct

SEQ ID NO: 550 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
tctggcagtggtttccagtgagg

SEQ ID NO: 551 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
agcacttctctttctggcagtgg

SEQ ID NO: 552 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aagcacttctctttctggcagtg

SEQ ID NO: 553 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttcaaagcacttctctttctggc

SEQ ID NO: 554 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methyluridine-3'-phosphate
  modified_base 20: mod_base = OTHER; note = 2'-deoxy-2'-fluorocytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
tctcaaagcacttctctttctgg

SEQ ID NO: 555 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroguanosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-O-methylguanosine-3'-phosphate
  modified_base 10: mod_base = OTHER; note = 2'-deoxy-2'-fluoroguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluorocytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
taagctgaggctcaaagcacttc

SEQ ID NO: 556 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methylguanosine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
tcatatctcattcttgtggaaaa

SEQ ID NO: 557 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluorocytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
accatatctcattcttgtggaaa

SEQ ID NO: 558 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
taccatatctcattcttgtggaa

SEQ ID NO: 559 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tctataccatatctcattcttgt

SEQ ID NO: 560 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methylcytidine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
tgcttgctcagttctataccata

SEQ ID NO: 561 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
tctgcttgctcagttctatacca

SEQ ID NO: 562 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-deoxy-2'-fluorocytidine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methyluridine-3'-phosphate
  modified_base 20: mod_base = OTHER; note = 2'-deoxy-2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
tagctgcttgctcagttctatac

SEQ ID NO: 563 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-deoxy-2'-fluorocytidine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
tacccttgcactggcatctggcc

SEQ ID NO: 564 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-deoxy-2'-fluorocytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
tatcaggacccttgcactggcat

SEQ ID NO: 565 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylguanosine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
tgcatcaggacccttgcactggc

SEQ ID NO: 566 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluoroguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
atcatagcagcttgccttggtgt

SEQ ID NO: 567 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
tatcatagcagcttgccttggtg

SEQ ID NO: 568 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methylguanosine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-deoxy-2'-fluorocytidine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
tatgagtgggacatgaagcctag

SEQ ID NO: 569 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-deoxy-2'-fluoroadenosine-3'-phosphate
  modified_base 19: mod_base = OTHER; note = 2'-O-methylguanosine-3'-phosphate
  modified_base 20: mod_base = OTHER; note = 2'-deoxy-2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
aagacagactcttgcggagccgc

SEQ ID NO: 570 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroguanosine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
taagacagactcttgcggagccg

SEQ ID NO: 571 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-deoxy-2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
atcgaagacagactcttgcggag

SEQ ID NO: 572 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluoroguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
tattcttcagccccctcgaactg

SEQ ID NO: 573 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-deoxy-2'-fluoroguanosine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methyluridine-3'-phosphate
  modified_base 20: mod_base = OTHER; note = 2'-deoxy-2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
tgggacacaatcttgccttccat

SEQ ID NO: 574 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-deoxy-2'-fluorocytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
taatgggacacaatcttgccttc

SEQ ID NO: 575 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-deoxy-2'-fluoroadenosine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttcaaagcactttattgagtttc

SEQ ID NO: 576 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
acgttttcaaagcactttattga

SEQ ID NO: 577 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluorocytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
tctcagcattttcaaagcacttt

SEQ ID NO: 578 - RNA, 21 nt, synthetic construct
  source 1..21: mol_type = other RNA
gaggaaattgactgcaatgaa

SEQ ID NO: 579 - RNA, 21 nt, synthetic construct
  source 1..21: mol_type = other RNA
cacgttttattccttcaagta

SEQ ID NO: 580 - RNA, 21 nt, synthetic construct
  source 1..21: mol_type = other RNA
tacctactcaattgtgcaaaa

SEQ ID NO: 581 - RNA, 21 nt, synthetic construct
  source 1..21: mol_type = other RNA
ctttctatttcaagattgaca

SEQ ID NO: 582 - RNA, 21 nt, synthetic construct
  source 1..21: mol_type = other RNA
aaccacatgttccaaggaaaa

SEQ ID NO: 583 - RNA, 21 nt, synthetic construct
  source 1..21: mol_type = other RNA
aataaaagaagaaacaactgt

SEQ ID NO: 584 - RNA, 21 nt, synthetic construct
  source 1..21: mol_type = other RNA
agaagaaacaactgtaagtca

SEQ ID NO: 585 - RNA, 21 nt, synthetic construct
  source 1..21: mol_type = other RNA
cgggattcaggaaaagaacaa

SEQ ID NO: 586 - RNA, 21 nt, synthetic construct
  source 1..21: mol_type = other RNA
gggattcaggaaaagaacaaa

SEQ ID NO: 587 - RNA, 21 nt, synthetic construct
  source 1..21: mol_type = other RNA
ggattcaggaaaagaacaaga

SEQ ID NO: 588 - RNA, 21 nt, synthetic construct
  source 1..21: mol_type = other RNA
gattcaggaaaagaacaagga

SEQ ID NO: 589 - RNA, 21 nt, synthetic construct
  source 1..21: mol_type = other RNA
attcaggaaaagaacaaggga

SEQ ID NO: 590 - RNA, 21 nt, synthetic construct
  source 1..21: mol_type = other RNA
aaacatgaacgtgaccaagga

SEQ ID NO: 591 - RNA, 21 nt, synthetic construct
  source 1..21: mol_type = other RNA
cacgaacaacagcatggtctt

SEQ ID NO: 592 - RNA, 21 nt, synthetic construct
  source 1..21: mol_type = other RNA
ggtcttggtcatggacataaa

SEQ ID NO: 593 - RNA, 21 nt, synthetic construct
  source 1..21: mol_type = other RNA
cttggtcatggacataagtta

SEQ ID NO: 594 - RNA, 21 nt, synthetic construct
  source 1..21: mol_type = other RNA
ttggtcatggacataagttca

SEQ ID NO: 595 - RNA, 21 nt, synthetic construct
  source 1..21: mol_type = other RNA
ggtcatggacataagttcaaa

SEQ ID NO: 596 - RNA, 21 nt, synthetic construct
  source 1..21: mol_type = other RNA
atggacataagttcaaactta

SEQ ID NO: 597 - RNA, 21 nt, synthetic construct
  source 1..21: mol_type = other RNA
ggacataagttcaaacttgat

SEQ ID NO: 598 - RNA, 21 nt, synthetic construct
  source 1..21: mol_type = other RNA
cataagttcaaacttgatgat

SEQ ID NO: 599 - RNA, 21 nt, synthetic construct
  source 1..21: mol_type = other RNA
ataagttcaaacttgatgata

SEQ ID NO: 600 - RNA, 21 nt, synthetic construct
  source 1..21: mol_type = other RNA
ttcaaacttgatgatgatctt

SEQ ID NO: 601 - RNA, 21 nt, synthetic construct
  source 1..21: mol_type = other RNA
tcaaacttgatgatgatctta

SEQ ID NO: 602 - RNA, 21 nt, synthetic construct
  source 1..21: mol_type = other RNA
aacttgatgatgatcttgaaa

SEQ ID NO: 603 - RNA, 21 nt, synthetic construct
  source 1..21: mol_type = other RNA
gtccttgaccatggacataaa

SEQ ID NO: 604 - RNA, 21 nt, synthetic construct
  source 1..21: mol_type = other RNA
gaccatggacataagcataaa

SEQ ID NO: 605 - RNA, 21 nt, synthetic construct
  source 1..21: mol_type = other RNA
atggacataagcataagcata

SEQ ID NO: 606 - RNA, 21 nt, synthetic construct
  source 1..21: mol_type = other RNA
gaatggaaagcacaatggtta

SEQ ID NO: 607 - RNA, 21 nt, synthetic construct
  source 1..21: mol_type = other RNA
gaaagcacaatggttggaaaa

SEQ ID NO: 608 - RNA, 21 nt, synthetic construct
  source 1..21: mol_type = other RNA
aagcacaatggttggaaaaca

SEQ ID NO: 609 - RNA, 21 nt, synthetic construct
  source 1..21: mol_type = other RNA
atggttggaaaacagagcatt

SEQ ID NO: 610 - RNA, 21 nt, synthetic construct
  source 1..21: mol_type = other RNA
ggttggaaaacagagcattta

SEQ ID NO: 611 - RNA, 21 nt, synthetic construct
  source 1..21: mol_type = other RNA
atttggcaagctcttctgaaa

SEQ ID NO: 612 - RNA, 21 nt, synthetic construct
  source 1..21: mol_type = other RNA
tcttctgaagacagtactaca

SEQ ID NO: 613 - RNA, 21 nt, synthetic construct
  source 1..21: mol_type = other RNA
cagagtgatgacgattggata

SEQ ID NO: 614 - RNA, 21 nt, synthetic construct
  source 1..21: mol_type = other RNA
ctttcatttaacccaatatca

SEQ ID NO: 615 - RNA, 21 nt, synthetic construct
  source 1..21: mol_type = other RNA
tttcatttaacccaatatcaa

SEQ ID NO: 616 - RNA, 21 nt, synthetic construct
  source 1..21: mol_type = other RNA
tttaacccaatatcagatttt

SEQ ID NO: 617 - RNA, 21 nt, synthetic construct
  source 1..21: mol_type = other RNA
ttaacccaatatcagatttta

SEQ ID NO: 618 - RNA, 21 nt, synthetic construct
  source 1..21: mol_type = other RNA
gtggctatgggtatttcttta

SEQ ID NO: 619 - RNA, 21 nt, synthetic construct
  source 1..21: mol_type = other RNA
tttctttcatactttattaaa

SEQ ID NO: 620 - RNA, 21 nt, synthetic construct
  source 1..21: mol_type = other RNA
ttctttcatactttattaaaa

SEQ ID NO: 621 - RNA, 21 nt, synthetic construct
  source 1..21: mol_type = other RNA
tctttcatactttattaaagt

SEQ ID NO: 622 - RNA, 21 nt, synthetic construct
  source 1..21: mol_type = other RNA
ttcatactttattaaagtata

SEQ ID NO: 623 - RNA, 21 nt, synthetic construct
  source 1..21: mol_type = other RNA
ctttattaaagtatcaatata

SEQ ID NO: 624 - RNA, 21 nt, synthetic construct
  source 1..21: mol_type = other RNA
tttattaaagtatcaatatca

SEQ ID NO: 625 - RNA, 21 nt, synthetic construct
  source 1..21: mol_type = other RNA
aagtatcaatatccctctcta

SEQ ID NO: 626 - RNA, 21 nt, synthetic construct
  source 1..21: mol_type = other RNA
cattgtccagatgaaaatata

SEQ ID NO: 627 - RNA, 21 nt, synthetic construct
  source 1..21: mol_type = other RNA
atgaaaatatcctgatataat

SEQ ID NO: 628 - RNA, 21 nt, synthetic construct
  source 1..21: mol_type = other RNA
tctccacggactgcataaaat

SEQ ID NO: 629 - RNA, 21 nt, synthetic construct
  source 1..21: mol_type = other RNA
cacggactgcataaaattgta

SEQ ID NO: 630 - RNA, 21 nt, synthetic construct
  source 1..21: mol_type = other RNA
ctgcaattggcttctctgata

SEQ ID NO: 631 - RNA, 21 nt, synthetic construct
  source 1..21: mol_type = other RNA
tgataacaaatatgtacctta

SEQ ID NO: 632 - RNA, 21 nt, synthetic construct
  source 1..21: mol_type = other RNA
taccttacaacatatgtcata

SEQ ID NO: 633 - RNA, 21 nt, synthetic construct
  source 1..21: mol_type = other RNA
tacaacatatgtcatgaattt

SEQ ID NO: 634 - RNA, 21 nt, synthetic construct
  source 1..21: mol_type = other RNA
attcttgtcattcttaataaa

SEQ ID NO: 635 - RNA, 21 nt, synthetic construct
  source 1..21: mol_type = other RNA
ttcttgtcattcttaataaaa

SEQ ID NO: 636 - RNA, 21 nt, synthetic construct
  source 1..21: mol_type = other RNA
tcttgtcattcttaataaact

SEQ ID NO: 637 - RNA, 21 nt, synthetic construct
  source 1..21: mol_type = other RNA
atttgaatgtgtgtgaaaata

SEQ ID NO: 638 - RNA, 21 nt, synthetic construct
  source 1..21: mol_type = other RNA
gaatgtgtgtgaaaataagga

SEQ ID NO: 639 - RNA, 21 nt, synthetic construct
  source 1..21: mol_type = other RNA
atgtgtgtgaaaataagggaa

SEQ ID NO: 640 - RNA, 21 nt, synthetic construct
  source 1..21: mol_type = other RNA
gtgtgtgaaaataagggaagt

SEQ ID NO: 641 - RNA, 21 nt, synthetic construct
  source 1..21: mol_type = other RNA
gtgtgaaaataagggaagtca

SEQ ID NO: 642 - RNA, 21 nt, synthetic construct
  source 1..21: mol_type = other RNA
tgtgaaaataagggaagtcaa

SEQ ID NO: 643 - RNA, 21 nt, synthetic construct
  source 1..21: mol_type = other RNA
gtgaaaataagggaagtcaaa

SEQ ID NO: 644 - RNA, 21 nt, synthetic construct
  source 1..21: mol_type = other RNA
aataagggaagtcaagagatt

SEQ ID NO: 645 - RNA, 21 nt, synthetic construct
  source 1..21: mol_type = other RNA
gggaagtcaagagattaaata

SEQ ID NO: 646 - RNA, 21 nt, synthetic construct
  source 1..21: mol_type = other RNA
taaatgctgaacttattaata

SEQ ID NO: 647 - RNA, 23 nt, synthetic construct
  source 1..23: mol_type = other RNA
ttcattgcagtcaatttcctcgg

SEQ ID NO: 648 - RNA, 23 nt, synthetic construct
  source 1..23: mol_type = other RNA
tacttgaaggaataaaacgtgtc

SEQ ID NO: 649 - RNA, 23 nt, synthetic construct
  source 1..23: mol_type = other RNA
ttttgcacaattgagtaggtaat

SEQ ID NO: 650 - RNA, 23 nt, synthetic construct
  source 1..23: mol_type = other RNA
tgtcaatcttgaaatagaaagtt

SEQ ID NO: 651 - RNA, 23 nt, synthetic construct
  source 1..23: mol_type = other RNA
ttttccttggaacatgtggtttc

SEQ ID NO: 652 - RNA, 23 nt, synthetic construct
  source 1..23: mol_type = other RNA
acagttgtttcttcttttatttc

SEQ ID NO: 653 - RNA, 23 nt, synthetic construct
  source 1..23: mol_type = other RNA
tgacttacagttgtttcttcttt

SEQ ID NO: 654 - RNA, 23 nt, synthetic construct
  source 1..23: mol_type = other RNA
ttgttcttttcctgaatcccgct

SEQ ID NO: 655 - RNA, 23 nt, synthetic construct
  source 1..23: mol_type = other RNA
tttgttcttttcctgaatcccgc

SEQ ID NO: 656 - RNA, 23 nt, synthetic construct
  source 1..23: mol_type = other RNA
tcttgttcttttcctgaatcccg

SEQ ID NO: 657 - RNA, 23 nt, synthetic construct
  source 1..23: mol_type = other RNA
tccttgttcttttcctgaatccc

SEQ ID NO: 658 - RNA, 23 nt, synthetic construct
  source 1..23: mol_type = other RNA
tcccttgttcttttcctgaatcc

SEQ ID NO: 659 - RNA, 23 nt, synthetic construct
  source 1..23: mol_type = other RNA
tccttggtcacgttcatgtttat

SEQ ID NO: 660 - RNA, 23 nt, synthetic construct
  source 1..23: mol_type = other RNA
aagaccatgctgttgttcgtgtc

SEQ ID NO: 661 - RNA, 23 nt, synthetic construct
  source 1..23: mol_type = other RNA
tttatgtccatgaccaagaccat

SEQ ID NO: 662 - RNA, 23 nt, synthetic construct
  source 1..23: mol_type = other RNA
taacttatgtccatgaccaagac

SEQ ID NO: 663 - RNA, 23 nt, synthetic construct
  source 1..23: mol_type = other RNA
tgaacttatgtccatgaccaaga

SEQ ID NO: 664 - RNA, 23 nt, synthetic construct
  source 1..23: mol_type = other RNA
tttgaacttatgtccatgaccaa

SEQ ID NO: 665 - RNA, 23 nt, synthetic construct
  source 1..23: mol_type = other RNA
taagtttgaacttatgtccatga

SEQ ID NO: 666 - RNA, 23 nt, synthetic construct
  source 1..23: mol_type = other RNA
atcaagtttgaacttatgtccat

SEQ ID NO: 667 - RNA, 23 nt, synthetic construct
  source 1..23: mol_type = other RNA
atcatcaagtttgaacttatgtc

SEQ ID NO: 668 - RNA, 23 nt, synthetic construct
  source 1..23: mol_type = other RNA
tatcatcaagtttgaacttatgt

SEQ ID NO: 669 - RNA, 23 nt, synthetic construct
  source 1..23: mol_type = other RNA
aagatcatcatcaagtttgaact

SEQ ID NO: 670 - RNA, 23 nt, synthetic construct
  source 1..23: mol_type = other RNA
taagatcatcatcaagtttgaac

SEQ ID NO: 671 - RNA, 23 nt, synthetic construct
  source 1..23: mol_type = other RNA
tttcaagatcatcatcaagtttg

SEQ ID NO: 672 - RNA, 23 nt, synthetic construct
  source 1..23: mol_type = other RNA
tttatgtccatggtcaaggacat

SEQ ID NO: 673 - RNA, 23 nt, synthetic construct
  source 1..23: mol_type = other RNA
tttatgcttatgtccatggtcaa

SEQ ID NO: 674 - RNA, 23 nt, synthetic construct
  source 1..23: mol_type = other RNA
tatgcttatgcttatgtccatgg

SEQ ID NO: 675 - RNA, 23 nt, synthetic construct
  source 1..23: mol_type = other RNA
taaccattgtgctttccattctt

SEQ ID NO: 676 - RNA, 23 nt, synthetic construct
  source 1..23: mol_type = other RNA
ttttccaaccattgtgctttcca

SEQ ID NO: 677 - RNA, 23 nt, synthetic construct
  source 1..23: mol_type = other RNA
tgttttccaaccattgtgctttc

SEQ ID NO: 678 - RNA, 23 nt, synthetic construct
  source 1..23: mol_type = other RNA
aatgctctgttttccaaccattg

SEQ ID NO: 679 - RNA, 23 nt, synthetic construct
  source 1..23: mol_type = other RNA
taaatgctctgttttccaaccat

SEQ ID NO: 680 - RNA, 23 nt, synthetic construct
  source 1..23: mol_type = other RNA
tttcagaagagcttgccaaatgc

SEQ ID NO: 681 - RNA, 23 nt, synthetic construct
  source 1..23: mol_type = other RNA
tgtagtactgtcttcagaagagc

SEQ ID NO: 682 - RNA, 23 nt, synthetic construct
  source 1..23: mol_type = other RNA
tatccaatcgtcatcactctgta

SEQ ID NO: 683 - RNA, 23 nt, synthetic construct
  source 1..23: mol_type = other RNA
tgatattgggttaaatgaaaggc

SEQ ID NO: 684 - RNA, 23 nt, synthetic construct
  source 1..23: mol_type = other RNA
ttgatattgggttaaatgaaagg

SEQ ID NO: 685 - RNA, 23 nt, synthetic construct
  source 1..23: mol_type = other RNA
aaaatctgatattgggttaaatg

SEQ ID NO: 686 - RNA, 23 nt, synthetic construct
  source 1..23: mol_type = other RNA
taaaatctgatattgggttaaat

SEQ ID NO: 687 - RNA, 23 nt, synthetic construct
  source 1..23: mol_type = other RNA
taaagaaatacccatagccactt

SEQ ID NO: 688 - RNA, 23 nt, synthetic construct
  source 1..23: mol_type = other RNA
tttaataaagtatgaaagaaata

SEQ ID NO: 689 - RNA, 23 nt, synthetic construct
  source 1..23: mol_type = other RNA
ttttaataaagtatgaaagaaat

SEQ ID NO: 690 - RNA, 23 nt, synthetic construct
  source 1..23: mol_type = other RNA
actttaataaagtatgaaagaaa

SEQ ID NO: 691 - RNA, 23 nt, synthetic construct
  source 1..23: mol_type = other RNA
tatactttaataaagtatgaaag

SEQ ID NO: 692 - RNA, 23 nt, synthetic construct
  source 1..23: mol_type = other RNA
tatattgatactttaataaagta

SEQ ID NO: 693 - RNA, 23 nt, synthetic construct
  source 1..23: mol_type = other RNA
tgatattgatactttaataaagt

SEQ ID NO: 694 - RNA, 23 nt, synthetic construct
  source 1..23: mol_type = other RNA
tagagagggatattgatacttta

SEQ ID NO: 695 - RNA, 23 nt, synthetic construct
  source 1..23: mol_type = other RNA
tatattttcatctggacaatgga

SEQ ID NO: 696 - RNA, 23 nt, synthetic construct
  source 1..23: mol_type = other RNA
attatatcaggatattttcatct

SEQ ID NO: 697 - RNA, 23 nt, synthetic construct
  source 1..23: mol_type = other RNA
attttatgcagtccgtggagact

SEQ ID NO: 698 - RNA, 23 nt, synthetic construct
  source 1..23: mol_type = other RNA
tacaattttatgcagtccgtgga

SEQ ID NO: 699 - RNA, 23 nt, synthetic construct
  source 1..23: mol_type = other RNA
tatcagagaagccaattgcagca

SEQ ID NO: 700 - RNA, 23 nt, synthetic construct
  source 1..23: mol_type = other RNA
taaggtacatatttgttatcaga

SEQ ID NO: 701 - RNA, 23 nt, synthetic construct
  source 1..23: mol_type = other RNA
tatgacatatgttgtaaggtaca

SEQ ID NO: 702 - RNA, 23 nt, synthetic construct
  source 1..23: mol_type = other RNA
aaattcatgacatatgttgtaag

SEQ ID NO: 703 - RNA, 23 nt, synthetic construct
  source 1..23: mol_type = other RNA
tttattaagaatgacaagaatct

SEQ ID NO: 704 - RNA, 23 nt, synthetic construct
  source 1..23: mol_type = other RNA
ttttattaagaatgacaagaatc

SEQ ID NO: 705 - RNA, 23 nt, synthetic construct
  source 1..23: mol_type = other RNA
agtttattaagaatgacaagaat

SEQ ID NO: 706 - RNA, 23 nt, synthetic construct
  source 1..23: mol_type = other RNA
tattttcacacacattcaaatac

SEQ ID NO: 707 - RNA, 23 nt, synthetic construct
  source 1..23: mol_type = other RNA
tccttattttcacacacattcaa

SEQ ID NO: 708 - RNA, 23 nt, synthetic construct
  source 1..23: mol_type = other RNA
ttcccttattttcacacacattc

SEQ ID NO: 709 - RNA, 23 nt, synthetic construct
  source 1..23: mol_type = other RNA
acttcccttattttcacacacat

SEQ ID NO: 710 - RNA, 23 nt, synthetic construct
  source 1..23: mol_type = other RNA
tgacttcccttattttcacacac

SEQ ID NO: 711 - RNA, 23 nt, synthetic construct
  source 1..23: mol_type = other RNA
ttgacttcccttattttcacaca

SEQ ID NO: 712 - RNA, 23 nt, synthetic construct
  source 1..23: mol_type = other RNA
tttgacttcccttattttcacac

SEQ ID NO: 713 - RNA, 23 nt, synthetic construct
  source 1..23: mol_type = other RNA
aatctcttgacttcccttatttt

SEQ ID NO: 714 - RNA, 23 nt, synthetic construct
  source 1..23: mol_type = other RNA
tatttaatctcttgacttccctt

SEQ ID NO: 715 - RNA, 23 nt, synthetic construct
  source 1..23: mol_type = other RNA
tattaataagttcagcatttaat

SEQ ID NO: 716 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluorocytidine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaggaaattgactgcaatgaa

SEQ ID NO: 717 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methylguanosine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluorocytidine-3'-phosphate
  modified_base 14: mod_base = OTHER; note = 2'-O-methyluridine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacgttttattccttcaagta

SEQ ID NO: 718 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methylcytidine-3'-phosphate
  modified_base 5: mod_base = OTHER; note = 2'-deoxy-2'-fluorouridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacctactcaattgtgcaaaa

SEQ ID NO: 719 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluorocytidine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctttctatttcaagattgaca

SEQ ID NO: 720 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylguanosine-3'-phosphate
  modified_base 17: mod_base = OTHER; note = 2'-deoxy-2'-fluoroguanosine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaccacatgttccaaggaaaa

SEQ ID NO: 721 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluorocytidine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluorouridine-3'-phosphate
  modified_base 20: mod_base = OTHER; note = 2'-O-methylguanosine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aataaaagaagaaacaactgt

SEQ ID NO: 722 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methylguanosine-3'-phosphate
  modified_base 19: mod_base = OTHER; note = 2'-deoxy-2'-fluorouridine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agaagaaacaactgtaagtca

SEQ ID NO: 723 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylguanosine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluorocytidine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgggattcaggaaaagaacaa

SEQ ID NO: 724 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyladenosine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gggattcaggaaaagaacaaa

SEQ ID NO: 725 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyluridine-3'-phosphate
  modified_base 5: mod_base = OTHER; note = 2'-deoxy-2'-fluorouridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggattcaggaaaagaacaaga

SEQ ID NO: 726 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluorocytidine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gattcaggaaaagaacaagga

SEQ ID NO: 727 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluorocytidine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methylguanosine-3'-phosphate
  modified_base 19: mod_base = OTHER; note = 2'-deoxy-2'-fluoroguanosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attcaggaaaagaacaaggga

SEQ ID NO: 728 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluorocytidine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaacatgaacgtgaccaagga

SEQ ID NO: 729 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluorocytidine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacgaacaacagcatggtctt

SEQ ID NO: 730 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggtcttggtcatggacataaa

SEQ ID NO: 731 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methylguanosine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cttggtcatggacataagtta

SEQ ID NO: 732 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluorouridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyluridine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttggtcatggacataagttca

SEQ ID NO: 733 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggtcatggacataagttcaaa

SEQ ID NO: 734 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluorouridine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggacataagttcaaactta

SEQ ID NO: 735 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggacataagttcaaacttgat

SEQ ID NO: 736 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluorocytidine-3'-phosphate
  modified_base 14: mod_base = OTHER; note = 2'-O-methyluridine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cataagttcaaacttgatgat

SEQ ID NO: 737 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-deoxy-2'-fluorouridine-3'-phosphate
  modified_base 14: mod_base = OTHER; note = 2'-O-methyluridine-3'-phosphate
  modified_base 15: mod_base = OTHER; note = 2'-deoxy-2'-fluoroguanosine-3'-phosphate
  modified_base 16: mod_base = OTHER; note = 2'-O-methyladenosine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ataagttcaaacttgatgata

SEQ ID NO: 738 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluorocytidine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttcaaacttgatgatgatctt

SEQ ID NO: 739 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-deoxy-2'-fluoroadenosine-3'-phosphate
  modified_base 14: mod_base = OTHER; note = 2'-O-methyluridine-3'-phosphate
  modified_base 15: mod_base = OTHER; note = 2'-deoxy-2'-fluoroguanosine-3'-phosphate
  modified_base 16: mod_base = OTHER; note = 2'-O-methyladenosine-3'-phosphate
  modified_base 17: mod_base = OTHER; note = 2'-deoxy-2'-fluorouridine-3'-phosphate
  modified_base 18: mod_base = OTHER; note = 2'-O-methylcytidine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcaaacttgatgatgatctta

SEQ ID NO: 740 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyluridine-3'-phosphate
  modified_base 5: mod_base = OTHER; note = 2'-deoxy-2'-fluorouridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-deoxy-2'-fluoroadenosine-3'-phosphate
  modified_base 14: mod_base = OTHER; note = 2'-O-methyluridine-3'-phosphate
  modified_base 15: mod_base = OTHER; note = 2'-deoxy-2'-fluorocytidine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacttgatgatgatcttgaaa

SEQ ID NO: 741 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorocytidine-3'-phosphate
  modified_base 4: mod_base = OTHER; note = 2'-O-methylcytidine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtccttgaccatggacataaa

SEQ ID NO: 742 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaccatggacataagcataaa

SEQ ID NO: 743 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyluridine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggacataagcataagcata

SEQ ID NO: 744 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methylguanosine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaatggaaagcacaatggtta

SEQ ID NO: 745 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-deoxy-2'-fluoroguanosine-3'-phosphate
  modified_base 14: mod_base = OTHER; note = 2'-O-methyluridine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluoroguanosine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaaagcacaatggttggaaaa

SEQ ID NO: 746 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluoroguanosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagcacaatggttggaaaaca

SEQ ID NO: 747 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggttggaaaacagagcatt

SEQ ID NO: 748 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggttggaaaacagagcattta

SEQ ID NO: 749 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-deoxy-2'-fluorocytidine-3'-phosphate
  modified_base 14: mod_base = OTHER; note = 2'-O-methyluridine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atttggcaagctcttctgaaa

SEQ ID NO: 750 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluorocytidine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methylguanosine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-deoxy-2'-fluorocytidine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcttctgaagacagtactaca

SEQ ID NO: 751 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluorouridine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagagtgatgacgattggata

SEQ ID NO: 752 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluorocytidine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-deoxy-2'-fluorocytidine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctttcatttaacccaatatca

SEQ ID NO: 753 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluorocytidine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttcatttaacccaatatcaa

SEQ ID NO: 754 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methylguanosine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttaacccaatatcagatttt

SEQ ID NO: 755 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyladenosine-3'-phosphate
  modified_base 5: mod_base = OTHER; note = 2'-deoxy-2'-fluorocytidine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyladenosine-3'-phosphate
  modified_base 17: mod_base = OTHER; note = 2'-deoxy-2'-fluorouridine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttaacccaatatcagatttta

SEQ ID NO: 756 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluorocytidine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-O-methyluridine-3'-phosphate
  modified_base 15: mod_base = OTHER; note = 2'-deoxy-2'-fluorouridine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtggctatgggtatttcttta

SEQ ID NO: 757 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-deoxy-2'-fluorouridine-3'-phosphate
  modified_base 14: mod_base = OTHER; note = 2'-O-methyluridine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-deoxy-2'-fluorouridine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttctttcatactttattaaa

SEQ ID NO: 758 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorocytidine-3'-phosphate
  modified_base 4: mod_base = OTHER; note = 2'-O-methyluridine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-deoxy-2'-fluorouridine-3'-phosphate
  modified_base 14: mod_base = OTHER; note = 2'-O-methyluridine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttctttcatactttattaaaa

SEQ ID NO: 759 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluorouridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluorouridine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctttcatactttattaaagt

SEQ ID NO: 760 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluorouridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttcatactttattaaagtata

SEQ ID NO: 761 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-O-methyluridine-3'-phosphate
  modified_base 15: mod_base = OTHER; note = 2'-deoxy-2'-fluorocytidine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctttattaaagtatcaatata

SEQ ID NO: 762 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methyladenosine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttattaaagtatcaatatca

SEQ ID NO: 763 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluorocytidine-3'-phosphate
  modified_base 14: mod_base = OTHER; note = 2'-O-methylcytidine-3'-phosphate
  modified_base 15: mod_base = OTHER; note = 2'-deoxy-2'-fluorocytidine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 18: mod_base = OTHER; note = 2'-O-methyluridine-3'-phosphate
  modified_base 19: mod_base = OTHER; note = 2'-deoxy-2'-fluorocytidine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagtatcaatatccctctcta

SEQ ID NO: 764 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cattgtccagatgaaaatata

SEQ ID NO: 765 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgaaaatatcctgatataat

SEQ ID NO: 766 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluorocytidine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctccacggactgcataaaat

SEQ ID NO: 767 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methylguanosine-3'-phosphate
  modified_base 5: mod_base = OTHER; note = 2'-deoxy-2'-fluoroguanosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluorouridine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacggactgcataaaattgta

SEQ ID NO: 768 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-deoxy-2'-fluorouridine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgcaattggcttctctgata

SEQ ID NO: 769 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-deoxy-2'-fluorocytidine-3'-phosphate
  modified_base 18: mod_base = OTHER; note = 2'-O-methylcytidine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgataacaaatatgtacctta

SEQ ID NO: 770 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methylcytidine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluorouridine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taccttacaacatatgtcata

SEQ ID NO: 771 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacaacatatgtcatgaattt

SEQ ID NO: 772 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluorouridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluorocytidine-3'-phosphate
  modified_base 14: mod_base = OTHER; note = 2'-O-methyluridine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attcttgtcattcttaataaa

SEQ ID NO: 773 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorocytidine-3'-phosphate
  modified_base 4: mod_base = OTHER; note = 2'-O-methyluridine-3'-phosphate
  modified_base 5: mod_base = OTHER; note = 2'-deoxy-2'-fluorouridine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluorouridine-3'-phosphate
  modified_base 14: mod_base = OTHER; note = 2'-O-methyluridine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttcttgtcattcttaataaaa

SEQ ID NO: 774 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methylcytidine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcttgtcattcttaataaact

SEQ ID NO: 775 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyluridine-3'-phosphate
  modified_base 15: mod_base = OTHER; note = 2'-deoxy-2'-fluoroguanosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atttgaatgtgtgtgaaaata

SEQ ID NO: 776 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaatgtgtgtgaaaataagga

SEQ ID NO: 777 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methyluridine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methylguanosine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgtgtgtgaaaataagggaa

SEQ ID NO: 778 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methylguanosine-3'-phosphate
  modified_base 17: mod_base = OTHER; note = 2'-deoxy-2'-fluoroguanosine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgtgtgaaaataagggaagt

SEQ ID NO: 779 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methylguanosine-3'-phosphate
  modified_base 15: mod_base = OTHER; note = 2'-deoxy-2'-fluoroguanosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methylguanosine-3'-phosphate
  modified_base 19: mod_base = OTHER; note = 2'-deoxy-2'-fluorouridine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgtgaaaataagggaagtca

SEQ ID NO: 780 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluoroguanosine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluorocytidine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtgaaaataagggaagtcaa

SEQ ID NO: 781 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylguanosine-3'-phosphate
  modified_base 17: mod_base = OTHER; note = 2'-deoxy-2'-fluorouridine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgaaaataagggaagtcaaa

SEQ ID NO: 782 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylguanosine-3'-phosphate
  modified_base 17: mod_base = OTHER; note = 2'-deoxy-2'-fluoroadenosine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aataagggaagtcaagagatt

SEQ ID NO: 783 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluorouridine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gggaagtcaagagattaaata

SEQ ID NO: 784 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyladenosine-3'-phosphate
  modified_base 5: mod_base = OTHER; note = 2'-deoxy-2'-fluorouridine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-deoxy-2'-fluorouridine-3'-phosphate
  modified_base 14: mod_base = OTHER; note = 2'-O-methyluridine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taaatgctgaacttattaata

SEQ ID NO: 785 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
ttcattgcagtcaatttcctcgg

SEQ ID NO: 786 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-O-methylguanosine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluorocytidine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tacttgaaggaataaaacgtgtc

SEQ ID NO: 787 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-deoxy-2'-fluoroguanosine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
ttttgcacaattgagtaggtaat

SEQ ID NO: 788 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
tgtcaatcttgaaatagaaagtt

SEQ ID NO: 789 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylcytidine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttttccttggaacatgtggtttc

SEQ ID NO: 790 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
acagttgtttcttcttttatttc

SEQ ID NO: 791 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluorocytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methyluridine-3'-phosphate
  modified_base 20: mod_base = OTHER; note = 2'-deoxy-2'-fluorocytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
tgacttacagttgtttcttcttt

SEQ ID NO: 792 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
ttgttcttttcctgaatcccgct

SEQ ID NO: 793 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluorouridine-3'-phosphate
  modified_base 19: mod_base = OTHER; note = 2'-O-methylcytidine-3'-phosphate
  modified_base 20: mod_base = OTHER; note = 2'-deoxy-2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
tttgttcttttcctgaatcccgc

SEQ ID NO: 794 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
tcttgttcttttcctgaatcccg

SEQ ID NO: 795 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
tccttgttcttttcctgaatccc

SEQ ID NO: 796 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-deoxy-2'-fluorocytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
tcccttgttcttttcctgaatcc

SEQ ID NO: 797 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyluridine
tccttggtcacgttcatgtttat

SEQ ID NO: 798 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
aagaccatgctgttgttcgtgtc

SEQ ID NO: 799 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
tttatgtccatgaccaagaccat

SEQ ID NO: 800 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluorocytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
taacttatgtccatgaccaagac

SEQ ID NO: 801 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
tgaacttatgtccatgaccaaga

SEQ ID NO: 802 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
tttgaacttatgtccatgaccaa

SEQ ID NO: 803 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methyladenosine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
taagtttgaacttatgtccatga

SEQ ID NO: 804 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-deoxy-2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
atcaagtttgaacttatgtccat

SEQ ID NO: 805 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
atcatcaagtttgaacttatgtc

SEQ ID NO: 806 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-O-methyladenosine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methyluridine-3'-phosphate
  modified_base 20: mod_base = OTHER; note = 2'-deoxy-2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tatcatcaagtttgaacttatgt

SEQ ID NO: 807 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
aagatcatcatcaagtttgaact

SEQ ID NO: 808 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroguanosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-deoxy-2'-fluorocytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
taagatcatcatcaagtttgaac

SEQ ID NO: 809 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-deoxy-2'-fluorocytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-deoxy-2'-fluoroadenosine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
tttcaagatcatcatcaagtttg

SEQ ID NO: 810 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluoroguanosine-3'-phosphate
  modified_base 19: mod_base = OTHER; note = 2'-O-methylguanosine-3'-phosphate
  modified_base 20: mod_base = OTHER; note = 2'-deoxy-2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
tttatgtccatggtcaaggacat

SEQ ID NO: 811 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
tttatgcttatgtccatggtcaa

SEQ ID NO: 812 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
tatgcttatgcttatgtccatgg

SEQ ID NO: 813 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluorocytidine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
taaccattgtgctttccattctt

SEQ ID NO: 814 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylcytidine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-deoxy-2'-fluorocytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methyluridine-3'-phosphate
  modified_base 20: mod_base = OTHER; note = 2'-deoxy-2'-fluorouridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
ttttccaaccattgtgctttcca

SEQ ID NO: 815 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tgttttccaaccattgtgctttc

SEQ ID NO: 816 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aatgctctgttttccaaccattg

SEQ ID NO: 817 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
taaatgctctgttttccaaccat

SEQ ID NO: 818 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-O-methylguanosine-3'-phosphate
  modified_base 10: mod_base = OTHER; note = 2'-deoxy-2'-fluoroadenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
tttcagaagagcttgccaaatgc

SEQ ID NO: 819 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
tgtagtactgtcttcagaagagc

SEQ ID NO: 820 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
tatccaatcgtcatcactctgta

SEQ ID NO: 821 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methylguanosine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
tgatattgggttaaatgaaaggc

SEQ ID NO: 822 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluoroguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
ttgatattgggttaaatgaaagg

SEQ ID NO: 823 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aaaatctgatattgggttaaatg

SEQ ID NO: 824 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-deoxy-2'-fluorouridine-3'-phosphate
  modified_base 19: mod_base = OTHER; note = 2'-O-methyluridine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
taaaatctgatattgggttaaat

SEQ ID NO: 825 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
taaagaaatacccatagccactt

SEQ ID NO: 826 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-O-methyladenosine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
tttaataaagtatgaaagaaata

SEQ ID NO: 827 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-O-methyladenosine-3'-phosphate
  modified_base 10: mod_base = OTHER; note = 2'-deoxy-2'-fluoroadenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluoroadenosine-3'-phosphate
  modified_base 19: mod_base = OTHER; note = 2'-O-methylguanosine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
ttttaataaagtatgaaagaaat

SEQ ID NO: 828 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
actttaataaagtatgaaagaaa

SEQ ID NO: 829 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
tatactttaataaagtatgaaag

SEQ ID NO: 830 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
tatattgatactttaataaagta

SEQ ID NO: 831 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluorouridine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tgatattgatactttaataaagt

SEQ ID NO: 832 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroguanosine-3'-phosphate
  modified_base 9: mod_base = OTHER; note = 2'-O-methylguanosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine
tagagagggatattgatacttta

SEQ ID NO: 833 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
tatattttcatctggacaatgga

SEQ ID NO: 834 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluoroguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
attatatcaggatattttcatct

SEQ ID NO: 835 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
attttatgcagtccgtggagact

SEQ ID NO: 836 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-deoxy-2'-fluorocytidine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
tacaattttatgcagtccgtgga

SEQ ID NO: 837 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methyladenosine-3'-phosphate
  modified_base 10: mod_base = OTHER; note = 2'-deoxy-2'-fluoroadenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
tatcagagaagccaattgcagca

SEQ ID NO: 838 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroguanosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
taaggtacatatttgttatcaga

SEQ ID NO: 839 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluoroguanosine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
tatgacatatgttgtaaggtaca

SEQ ID NO: 840 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
aaattcatgacatatgttgtaag

SEQ ID NO: 841 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-O-methylguanosine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
tttattaagaatgacaagaatct

SEQ ID NO: 842 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-O-methyladenosine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-deoxy-2'-fluoroadenosine-3'-phosphate
  modified_base 19: mod_base = OTHER; note = 2'-O-methylguanosine-3'-phosphate
  modified_base 20: mod_base = OTHER; note = 2'-deoxy-2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttttattaagaatgacaagaatc

SEQ ID NO: 843 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluoroadenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
agtttattaagaatgacaagaat

SEQ ID NO: 844 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
tattttcacacacattcaaatac

SEQ ID NO: 845 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
tccttattttcacacacattcaa

SEQ ID NO: 846 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluorocytidine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttcccttattttcacacacattc

SEQ ID NO: 847 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylcytidine-3'-phosphate
  modified_base 6: mod_base = OTHER; note = 2'-deoxy-2'-fluorocytidine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
acttcccttattttcacacacat

SEQ ID NO: 848 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluorocytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluorocytidine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
tgacttcccttattttcacacac

SEQ ID NO: 849 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methylcytidine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
ttgacttcccttattttcacaca

SEQ ID NO: 850 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluorocytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
tttgacttcccttattttcacac

SEQ ID NO: 851 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
aatctcttgacttcccttatttt

SEQ ID NO: 852 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methylcytidine-3'-phosphate
  modified_base 20: mod_base = OTHER; note = 2'-deoxy-2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
tatttaatctcttgacttccctt

SEQ ID NO: 853 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-O-methyladenosine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-deoxy-2'-fluorouridine-3'-phosphate
  modified_base 19: mod_base = OTHER; note = 2'-O-methyluridine-3'-phosphate
  modified_base 20: mod_base = OTHER; note = 2'-deoxy-2'-fluorouridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
tattaataagttcagcatttaat

SEQ ID NO: 854 - RNA, 21 nt, synthetic construct
  source 1..21: mol_type = other RNA
aatccaaaatattctacaaaa

SEQ ID NO: 855 - RNA, 21 nt, synthetic construct
  source 1..21: mol_type = other RNA
aatccaaaatattctacaaaa

SEQ ID NO: 856 - RNA, 21 nt, synthetic construct
  source 1..21: mol_type = other RNA
aatccaaaatattctacaaaa

SEQ ID NO: 857 - RNA, 21 nt, synthetic construct
  source 1..21: mol_type = other RNA
accaaagtcgctgagtacata

SEQ ID NO: 858 - RNA, 21 nt, synthetic construct
  source 1..21: mol_type = other RNA
accaaagtcgctgagtacata

SEQ ID NO: 859 - RNA, 21 nt, synthetic construct
  source 1..21: mol_type = other RNA
accaaagtcgctgagtacata

SEQ ID NO: 860 - RNA, 21 nt, synthetic construct
  source 1..21: mol_type = other RNA
gtggtcatcaaataagtgctt

SEQ ID NO: 861 - RNA, 21 nt, synthetic construct
  source 1..21: mol_type = other RNA
gtggtcatcaaataagtgctt

SEQ ID NO: 862 - RNA, 21 nt, synthetic construct
  source 1..21: mol_type = other RNA
gtggtcatcaaataagtgctt

SEQ ID NO: 863 - RNA, 23 nt, synthetic construct
  source 1..23: mol_type = other RNA
ttttgtagaatattttggatttc

SEQ ID NO: 864 - RNA, 23 nt, synthetic construct
  source 1..23: mol_type = other RNA
ttttgtagaatattttggatttc

SEQ ID NO: 865 - RNA, 23 nt, synthetic construct
  source 1..23: mol_type = other RNA
ttttgtagaatattttggatttc

SEQ ID NO: 866 - RNA, 23 nt, synthetic construct
  source 1..23: mol_type = other RNA
tatgtactcagcgactttggtgt

SEQ ID NO: 867 - RNA, 23 nt, synthetic construct
  source 1..23: mol_type = other RNA
tatgtactcagcgactttggtgt

SEQ ID NO: 868 - RNA, 23 nt, synthetic construct
  source 1..23: mol_type = other RNA
tatgtactcagcgactttggtgt

SEQ ID NO: 869 - RNA, 23 nt, synthetic construct
  source 1..23: mol_type = other RNA
aagcacttatttgatgaccacat

SEQ ID NO: 870 - RNA, 23 nt, synthetic construct
  source 1..23: mol_type = other RNA
aagcacttatttgatgaccacat

SEQ ID NO: 871 - RNA, 23 nt, synthetic construct
  source 1..23: mol_type = other RNA
aagcacttatttgatgaccacat

SEQ ID NO: 872 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluorocytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluorouridine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatccaaaatattctacaaaa

SEQ ID NO: 873 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatccaaaatattctacaaaa

SEQ ID NO: 874 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatccaaaatattctacaaaa

SEQ ID NO: 875 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accaaagtcgctgagtacata

SEQ ID NO: 876 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accaaagtcgctgagtacata

SEQ ID NO: 877 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accaaagtcgctgagtacata

SEQ ID NO: 878 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluorouridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylguanosine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluorocytidine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtggtcatcaaataagtgctt

SEQ ID NO: 879 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtggtcatcaaataagtgctt

SEQ ID NO: 880 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtggtcatcaaataagtgctt

SEQ ID NO: 881 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methyladenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttttgtagaatattttggatttc

SEQ ID NO: 882 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttttgtagaatattttggatttc

SEQ ID NO: 883 - RNA, 23 nt, synthetic construct
  source 1..23: mol_type = other RNA
  modified_base 1: mod_base = OTHER; note = 2'-deoxy-2'-fluorouridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttttgtagaatattttggatttc

SEQ ID NO: 884 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tatgtactcagcgactttggtgt

SEQ ID NO: 885 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tatgtactcagcgactttggtgt

SEQ ID NO: 886 - RNA, 23 nt, synthetic construct
  source 1..23: mol_type = other RNA
  modified_base 1: mod_base = OTHER; note = 2'-deoxy-2'-fluorouridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tatgtactcagcgactttggtgt

SEQ ID NO: 887 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aagcacttatttgatgaccacat

SEQ ID NO: 888 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aagcacttatttgatgaccacat

SEQ ID NO: 889 - RNA, 23 nt, synthetic construct
  source 1..23: mol_type = other RNA
  modified_base 1: mod_base = OTHER; note = 2'-deoxy-2'-fluoroadenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aagcacttatttgatgaccacat

SEQ ID NO: 890 - RNA, 21 nt, synthetic construct
  source 1..21: mol_type = other RNA
aactcaataaagtgctttgaa

SEQ ID NO: 891 - RNA, 21 nt, synthetic construct
  source 1..21: mol_type = other RNA
aactcaataaagtgctttgaa

SEQ ID NO: 892 - RNA, 21 nt, synthetic construct
  source 1..21: mol_type = other RNA
aactcaataaagtgctttgaa

SEQ ID NO: 893 - RNA, 21 nt, synthetic construct
  source 1..21: mol_type = other RNA
agcccaagaaagtgaaagaca

SEQ ID NO: 894 - RNA, 21 nt, synthetic construct
  source 1..21: mol_type = other RNA
aataaagtgctttgaaaacgt

SEQ ID NO: 895 - RNA, 21 nt, synthetic construct
  source 1..21: mol_type = other RNA
aataaagtgctttgaaaacgt

SEQ ID NO: 896 - RNA, 21 nt, synthetic construct
  source 1..21: mol_type = other RNA
cagaaagagaagtgctttgaa

SEQ ID NO: 897 - RNA, 21 nt, synthetic construct
  source 1..21: mol_type = other RNA
cagaaagagaagtgctttgaa

SEQ ID NO: 898 - RNA, 23 nt, synthetic construct
  source 1..23: mol_type = other RNA
ttcaaagcactttattgagtttc

SEQ ID NO: 899 - RNA, 23 nt, synthetic construct
  source 1..23: mol_type = other RNA
ttcaaagcactttattgagtttc

SEQ ID NO: 900 - RNA, 23 nt, synthetic construct
  source 1..23: mol_type = other RNA
ttcaaagcactttattgagtttc

SEQ ID NO: 901 - RNA, 23 nt, synthetic construct
  source 1..23: mol_type = other RNA
tgtctttcactttcttgggctcc

SEQ ID NO: 902 - RNA, 23 nt, synthetic construct
  source 1..23: mol_type = other RNA
acgttttcaaagcactttattga

SEQ ID NO: 903 - RNA, 23 nt, synthetic construct
  source 1..23: mol_type = other RNA
acgttttcaaagcactttattga

SEQ ID NO: 904 - RNA, 23 nt, synthetic construct
  source 1..23: mol_type = other RNA
ttcaaagcacttctctttctggc

SEQ ID NO: 905 - RNA, 23 nt, synthetic construct
  source 1..23: mol_type = other RNA
ttcaaagcacttctctttctggc

SEQ ID NO: 906 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyluridine-3'-phosphate
  modified_base 5: mod_base = OTHER; note = 2'-deoxy-2'-fluorocytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluorocytidine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aactcaataaagtgctttgaa

SEQ ID NO: 907 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aactcaataaagtgctttgaa

SEQ ID NO: 908 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aactcaataaagtgctttgaa

SEQ ID NO: 909 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorocytidine-3'-phosphate
  modified_base 4: mod_base = OTHER; note = 2'-O-methylcytidine-3'-phosphate
  modified_base 5: mod_base = OTHER; note = 2'-deoxy-2'-fluorocytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agcccaagaaagtgaaagaca

SEQ ID NO: 910 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aataaagtgctttgaaaacgt

SEQ ID NO: 911 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aataaagtgctttgaaaacgt

SEQ ID NO: 912 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagaaagagaagtgctttgaa

SEQ ID NO: 913 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagaaagagaagtgctttgaa

SEQ ID NO: 914 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-deoxy-2'-fluoroadenosine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttcaaagcactttattgagtttc

SEQ ID NO: 915 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttcaaagcactttattgagtttc

SEQ ID NO: 916 - RNA, 23 nt, synthetic construct
  source 1..23: mol_type = other RNA
  modified_base 1: mod_base = OTHER; note = 2'-deoxy-2'-fluorouridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttcaaagcactttattgagtttc

SEQ ID NO: 917 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-deoxy-2'-fluoroguanosine-3'-phosphate
  modified_base 19: mod_base = OTHER; note = 2'-O-methylguanosine-3'-phosphate
  modified_base 20: mod_base = OTHER; note = 2'-deoxy-2'-fluorocytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
tgtctttcactttcttgggctcc

SEQ ID NO: 918 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
acgttttcaaagcactttattga

SEQ ID NO: 919 - RNA, 23 nt, synthetic construct
  source 1..23: mol_type = other RNA
  modified_base 1: mod_base = OTHER; note = 2'-deoxy-2'-fluoroadenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
acgttttcaaagcactttattga

SEQ ID NO: 920 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttcaaagcacttctctttctggc

SEQ ID NO: 921 - RNA, 23 nt, synthetic construct
  source 1..23: mol_type = other RNA
  modified_base 1: mod_base = OTHER; note = 2'-deoxy-2'-fluorouridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttcaaagcacttctctttctggc

SEQ ID NO: 922 - RNA, 21 nt, synthetic construct
  source 1..21: mol_type = other RNA
gaggaaattgactgcaatgaa

SEQ ID NO: 923 - RNA, 21 nt, synthetic construct
  source 1..21: mol_type = other RNA
gaggaaattgactgcaatgaa

SEQ ID NO: 924 - RNA, 21 nt, synthetic construct
  source 1..21: mol_type = other RNA
gaggaaattgactgcaatgaa

SEQ ID NO: 925 - RNA, 21 nt, synthetic construct
  source 1..21: mol_type = other RNA
tacctactcaattgtgcaaaa

SEQ ID NO: 926 - RNA, 21 nt, synthetic construct
  source 1..21: mol_type = other RNA
tacctactcaattgtgcaaaa

SEQ ID NO: 927 - RNA, 21 nt, synthetic construct
  source 1..21: mol_type = other RNA
tacctactcaattgtgcaaaa

SEQ ID NO: 928 - RNA, 23 nt, synthetic construct
  source 1..23: mol_type = other RNA
ttcattgcagtcaatttcctcgg

SEQ ID NO: 929 - RNA, 23 nt, synthetic construct
  source 1..23: mol_type = other RNA
ttcattgcagtcaatttcctcgg

SEQ ID NO: 930 - RNA, 23 nt, synthetic construct
  source 1..23: mol_type = other RNA
ttcattgcagtcaatttcctcgg

SEQ ID NO: 931 - RNA, 23 nt, synthetic construct
  source 1..23: mol_type = other RNA
ttttgcacaattgagtaggtaat

SEQ ID NO: 932 - RNA, 23 nt, synthetic construct
  source 1..23: mol_type = other RNA
ttttgcacaattgagtaggtaat

SEQ ID NO: 933 - RNA, 23 nt, synthetic construct
  source 1..23: mol_type = other RNA
ttttgcacaattgagtaggtaat

SEQ ID NO: 934 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluorocytidine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaggaaattgactgcaatgaa

SEQ ID NO: 935 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaggaaattgactgcaatgaa

SEQ ID NO: 936 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaggaaattgactgcaatgaa

SEQ ID NO: 937 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methylcytidine-3'-phosphate
  modified_base 5: mod_base = OTHER; note = 2'-deoxy-2'-fluorouridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacctactcaattgtgcaaaa

SEQ ID NO: 938 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacctactcaattgtgcaaaa

SEQ ID NO: 939 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacctactcaattgtgcaaaa

SEQ ID NO: 940 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
ttcattgcagtcaatttcctcgg

SEQ ID NO: 941 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
ttcattgcagtcaatttcctcgg

SEQ ID NO: 942 - RNA, 23 nt, synthetic construct
  source 1..23: mol_type = other RNA
  modified_base 1: mod_base = OTHER; note = 2'-deoxy-2'-fluorouridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
ttcattgcagtcaatttcctcgg

SEQ ID NO: 943 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-deoxy-2'-fluoroguanosine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
ttttgcacaattgagtaggtaat

SEQ ID NO: 944 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
ttttgcacaattgagtaggtaat

SEQ ID NO: 945 - RNA, 23 nt, synthetic construct
  source 1..23: mol_type = other RNA
  modified_base 1: mod_base = OTHER; note = 2'-deoxy-2'-fluorouridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
ttttgcacaattgagtaggtaat

SEQ ID NO: 946 - RNA, 19 nt, synthetic construct
  source 1..19: mol_type = other RNA
gactcctggataggcagct

SEQ ID NO: 947 - RNA, 19 nt, synthetic construct
  source 1..19: mol_type = other RNA
taggcagctggaccaacga

SEQ ID NO: 948 - RNA, 19 nt, synthetic construct
  source 1..19: mol_type = other RNA
accaacggacggatgccat

SEQ ID NO: 949 - RNA, 19 nt, synthetic construct
  source 1..19: mol_type = other RNA
atgccatgagggctctgct

SEQ ID NO: 950 - RNA, 19 nt, synthetic construct
  source 1..19: mol_type = other RNA
gctctgctgctcctggggt

SEQ ID NO: 951 - RNA, 19 nt, synthetic construct
  source 1..19: mol_type = other RNA
tcctggggttcctgctggt

SEQ ID NO: 952 - RNA, 19 nt, synthetic construct
  source 1..19: mol_type = other RNA
ctgctggtgagcttggagt

SEQ ID NO: 953 - RNA, 19 nt, synthetic construct
  source 1..19: mol_type = other RNA
cttggagtcaacactttca

SEQ ID NO: 954 - RNA, 19 nt, synthetic construct
  source 1..19: mol_type = other RNA
actttcgattccaccttga

SEQ ID NO: 955 - RNA, 19 nt, synthetic construct
  source 1..19: mol_type = other RNA
ccaccttgggaagccccca

SEQ ID NO: 956 - RNA, 19 nt, synthetic construct
  source 1..19: mol_type = other RNA
gcccccaaggagcataagt

SEQ ID NO: 957 - RNA, 19 nt, synthetic construct
  source 1..19: mol_type = other RNA
cataagtacaaagctgaaa

SEQ ID NO: 958 - RNA, 19 nt, synthetic construct
  source 1..19: mol_type = other RNA
aagctgaagagcacacagt

SEQ ID NO: 959 - RNA, 19 nt, synthetic construct
  source 1..19: mol_type = other RNA
acacagtcgttctcactgt

SEQ ID NO: 960 - RNA, 19 nt, synthetic construct
  source 1..19: mol_type = other RNA
ttctcactgtcaccgggga

SEQ ID NO: 961 - RNA, 19 nt, synthetic construct
  source 1..19: mol_type = other RNA
accggggagccctgccact

SEQ ID NO: 962 - RNA, 19 nt, synthetic construct
  source 1..19: mol_type = other RNA
tgccacttccccttccagt

SEQ ID NO: 963 - RNA, 19 nt, synthetic construct
  source 1..19: mol_type = other RNA
ttccagtaccaccggcaga

SEQ ID NO: 964 - RNA, 19 nt, synthetic construct
  source 1..19: mol_type = other RNA
accggcagctgtaccacaa

SEQ ID NO: 965 - RNA, 19 nt, synthetic construct
  source 1..19: mol_type = other RNA
taccacaaatgtacccaca

SEQ ID NO: 966 - RNA, 19 nt, synthetic construct
  source 1..19: mol_type = other RNA
tacccacaagggccggcca

SEQ ID NO: 967 - RNA, 19 nt, synthetic construct
  source 1..19: mol_type = other RNA
gccggccaggccctcagca

SEQ ID NO: 968 - RNA, 19 nt, synthetic construct
  source 1..19: mol_type = other RNA
ctcagccctggtgtgctaa

SEQ ID NO: 969 - RNA, 19 nt, synthetic construct
  source 1..19: mol_type = other RNA
tgtgctaccacccccaact

SEQ ID NO: 970 - RNA, 19 nt, synthetic construct
  source 1..19: mol_type = other RNA
acccccaactttgatcaga

SEQ ID NO: 971 - RNA, 19 nt, synthetic construct
  source 1..19: mol_type = other RNA
atcaggaccagcgatggga

SEQ ID NO: 972 - RNA, 19 nt, synthetic construct
  source 1..19: mol_type = other RNA
agcgatggggatactgttt

SEQ ID NO: 973 - RNA, 19 nt, synthetic construct
  source 1..19: mol_type = other RNA
tactgtttggagcccaaga

SEQ ID NO: 974 - RNA, 19 nt, synthetic construct
  source 1..19: mol_type = other RNA
ccaagaaagtgaaagacca

SEQ ID NO: 975 - RNA, 19 nt, synthetic construct
  source 1..19: mol_type = other RNA
aaagaccactgcagcaaac

SEQ ID NO: 976 - RNA, 19 nt, synthetic construct
  source 1..19: mol_type = other RNA
tgcagcaaacacagcccct

SEQ ID NO: 977 - RNA, 19 nt, synthetic construct
  source 1..19: mol_type = other RNA
agcccctgccagaaaggaa

SEQ ID NO: 978 - RNA, 19 nt, synthetic construct
  source 1..19: mol_type = other RNA
agaaaggagggacctgtgt

SEQ ID NO: 979 - RNA, 19 nt, synthetic construct
  source 1..19: mol_type = other RNA
acctgtgtgaacatgccaa

SEQ ID NO: 980 - RNA, 19 nt, synthetic construct
  source 1..19: mol_type = other RNA
atgccaagcggcccccact

SEQ ID NO: 981 - RNA, 19 nt, synthetic construct
  source 1..19: mol_type = other RNA
gcccccactgtctctgtca

SEQ ID NO: 982 - RNA, 19 nt, synthetic construct
  source 1..19: mol_type = other RNA
cacctcactggaaaccact

SEQ ID NO: 983 - RNA, 19 nt, synthetic construct
  source 1..19: mol_type = other RNA
aaccactgccagaaagaga

SEQ ID NO: 984 - RNA, 19 nt, synthetic construct
  source 1..19: mol_type = other RNA
cagaaagagaagtgcttta

SEQ ID NO: 985 - RNA, 19 nt, synthetic construct
  source 1..19: mol_type = other RNA
tgctttgagcctcagctta

SEQ ID NO: 986 - RNA, 19 nt, synthetic construct
  source 1..19: mol_type = other RNA
cagcttctccggtttttca

SEQ ID NO: 987 - RNA, 19 nt, synthetic construct
  source 1..19: mol_type = other RNA
cggtttttccacaagaata

SEQ ID NO: 988 - RNA, 19 nt, synthetic construct
  source 1..19: mol_type = other RNA
caagaatgagatatggtat

SEQ ID NO: 989 - RNA, 19 nt, synthetic construct
  source 1..19: mol_type = other RNA
tatggtatagaactgagca

SEQ ID NO: 990 - RNA, 19 nt, synthetic construct
  source 1..19: mol_type = other RNA
tgagcaagcagctgtggca

SEQ ID NO: 991 - RNA, 19 nt, synthetic construct
  source 1..19: mol_type = other RNA
gctgtggccagatgccagt

SEQ ID NO: 992 - RNA, 19 nt, synthetic construct
  source 1..19: mol_type = other RNA
atgccagtgcaagggtcct

SEQ ID NO: 993 - RNA, 19 nt, synthetic construct
  source 1..19: mol_type = other RNA
aagggtcctgatgcccact

SEQ ID NO: 994 - RNA, 19 nt, synthetic construct
  source 1..19: mol_type = other RNA
tgcccactgccagcggcta

SEQ ID NO: 995 - RNA, 19 nt, synthetic construct
  source 1..19: mol_type = other RNA
cggctggccagccaggcct

SEQ ID NO: 996 - RNA, 19 nt, synthetic construct
  source 1..19: mol_type = other RNA
agccaggcctgccgcacca

SEQ ID NO: 997 - RNA, 19 nt, synthetic construct
  source 1..19: mol_type = other RNA
cgcaccaacccgtgcctca

SEQ ID NO: 998 - RNA, 19 nt, synthetic construct
  source 1..19: mol_type = other RNA
tgcctccatgggggtcgct

SEQ ID NO: 999 - RNA, 19 nt, synthetic construct
  source 1..19: mol_type = other RNA
ggggtcgctgcctagaggt

SEQ ID NO: 1000 - RNA, 19 nt, synthetic construct
  source 1..19: mol_type = other RNA
ctagaggtggagggccaca

SEQ ID NO: 1001 - RNA, 19 nt, synthetic construct
  source 1..19: mol_type = other RNA
agggccaccgcctgtgcca

SEQ ID NO: 1002 - RNA, 19 nt, synthetic construct
  source 1..19: mol_type = other RNA
tgtgccactgcccggtgga

SEQ ID NO: 1003 - RNA, 19 nt, synthetic construct
  source 1..19: mol_type = other RNA
cggtgggctacaccggaga

SEQ ID NO: 1004 - RNA, 19 nt, synthetic construct
  source 1..19: mol_type = other RNA
accggagccttctgcgaca

SEQ ID NO: 1005 - RNA, 19 nt, synthetic construct
  source 1..19: mol_type = other RNA
ttctgcgacgtggacacca

SEQ ID NO: 1006 - RNA, 19 nt, synthetic construct
  source 1..19: mol_type = other RNA
gacaccaaggcaagctgct

SEQ ID NO: 1007 - RNA, 19 nt, synthetic construct
  source 1..19: mol_type = other RNA
caagctgctatgatggcca

SEQ ID NO: 1008 - RNA, 19 nt, synthetic construct
  source 1..19: mol_type = other RNA
gatggccgcgggctcagct

SEQ ID NO: 1009 - RNA, 19 nt, synthetic construct
  source 1..19: mol_type = other RNA
tcagctaccgcggcctgga

SEQ ID NO: 1010 - RNA, 19 nt, synthetic construct
  source 1..19: mol_type = other RNA
cggcctggccaggaccaca

SEQ ID NO: 1011 - RNA, 19 nt, synthetic construct
  source 1..19: mol_type = other RNA
aggaccacgctctcgggta

SEQ ID NO: 1012 - RNA, 19 nt, synthetic construct
  source 1..19: mol_type = other RNA
tcgggtgcgccctgtcaga

SEQ ID NO: 1013 - RNA, 19 nt, synthetic construct
  source 1..19: mol_type = other RNA
ctgtcagccgtgggcctca

SEQ ID NO: 1014 - RNA, 19 nt, synthetic construct
  source 1..19: mol_type = other RNA
tgggcctcggaggccacct

SEQ ID NO: 1015 - RNA, 19 nt, synthetic construct
  source 1..19: mol_type = other RNA
ccacctaccggaacgtgaa

SEQ ID NO: 1016 - RNA, 19 nt, synthetic construct
  source 1..19: mol_type = other RNA
aacgtgactgccgagcaaa

SEQ ID NO: 1017 - RNA, 19 nt, synthetic construct
  source 1..19: mol_type = other RNA
cgagcaagcgcggaactga

SEQ ID NO: 1018 - RNA, 19 nt, synthetic construct
  source 1..19: mol_type = other RNA
cggaactggggactgggca

SEQ ID NO: 1019 - RNA, 19 nt, synthetic construct
  source 1..19: mol_type = other RNA
gactgggcggccacgcctt

SEQ ID NO: 1020 - RNA, 19 nt, synthetic construct
  source 1..19: mol_type = other RNA
acgccttctgccggaacca

SEQ ID NO: 1021 - RNA, 19 nt, synthetic construct
  source 1..19: mol_type = other RNA
cggaacccggacaacgaca

SEQ ID NO: 1022 - RNA, 19 nt, synthetic construct
  source 1..19: mol_type = other RNA
aacgacatccgcccgtggt

SEQ ID NO: 1023 - RNA, 19 nt, synthetic construct
  source 1..19: mol_type = other RNA
gcccgtggtgcttcgtgct

SEQ ID NO: 1024 - RNA, 19 nt, synthetic construct
  source 1..19: mol_type = other RNA
ttcgtgctgaaccgcgaca

SEQ ID NO: 1025 - RNA, 19 nt, synthetic construct
  source 1..19: mol_type = other RNA
accgcgaccggctgagcta

SEQ ID NO: 1026 - RNA, 19 nt, synthetic construct
  source 1..19: mol_type = other RNA
ctgagctgggagtactgca

SEQ ID NO: 1027 - RNA, 19 nt, synthetic construct
  source 1..19: mol_type = other RNA
tactgcgacctggcacagt

SEQ ID NO: 1028 - RNA, 19 nt, synthetic construct
  source 1..19: mol_type = other RNA
tggcacagtgccagaccca

SEQ ID NO: 1029 - RNA, 19 nt, synthetic construct
  source 1..19: mol_type = other RNA
agaccccaacccaggcgga

SEQ ID NO: 1030 - RNA, 19 nt, synthetic construct
  source 1..19: mol_type = other RNA
aggcggcgcctccgaccca

SEQ ID NO: 1031 - RNA, 19 nt, synthetic construct
  source 1..19: mol_type = other RNA
tccgaccccggtgtcccct

SEQ ID NO: 1032 - RNA, 19 nt, synthetic construct
  source 1..19: mol_type = other RNA
tgtcccctaggcttcatgt

SEQ ID NO: 1033 - RNA, 19 nt, synthetic construct
  source 1..19: mol_type = other RNA
ttcatgtcccactcatgca

SEQ ID NO: 1034 - RNA, 19 nt, synthetic construct
  source 1..19: mol_type = other RNA
actcatgcccgcgcagcca

SEQ ID NO: 1035 - RNA, 19 nt, synthetic construct
  source 1..19: mol_type = other RNA
cgcagccggcaccgccgaa

SEQ ID NO: 1036 - RNA, 19 nt, synthetic construct
  source 1..19: mol_type = other RNA
accgccgaagcctcagcca

SEQ ID NO: 1037 - RNA, 19 nt, synthetic construct
  source 1..19: mol_type = other RNA
tcagcccacgacccggaca

SEQ ID NO: 1038 - RNA, 19 nt, synthetic construct
  source 1..19: mol_type = other RNA
acccggaccccgcctcagt

SEQ ID NO: 1039 - RNA, 19 nt, synthetic construct
  source 1..19: mol_type = other RNA
cctcagtcccagaccccga

SEQ ID NO: 1040 - RNA, 19 nt, synthetic construct
  source 1..19: mol_type = other RNA
agaccccgggagccttgca

SEQ ID NO: 1041 - RNA, 19 nt, synthetic construct
  source 1..19: mol_type = other RNA
ccttgccggcgaagcggga

SEQ ID NO: 1042 - RNA, 19 nt, synthetic construct
  source 1..19: mol_type = other RNA
aagcgggagcagccgcctt

SEQ ID NO: 1043 - RNA, 19 nt, synthetic construct
  source 1..19: mol_type = other RNA
agccgccttccctgaccaa

SEQ ID NO: 1044 - RNA, 19 nt, synthetic construct
  source 1..19: mol_type = other RNA
tgaccaggaacggcccact

SEQ ID NO: 1045 - RNA, 19 nt, synthetic construct
  source 1..19: mol_type = other RNA
cggcccactgagctgcgga

SEQ ID NO: 1046 - RNA, 19 nt, synthetic construct
  source 1..19: mol_type = other RNA
tgcgggcagcggctccgca

SEQ ID NO: 1047 - RNA, 19 nt, synthetic construct
  source 1..19: mol_type = other RNA
cggctccgcaagagtctgt

SEQ ID NO: 1048 - RNA, 19 nt, synthetic construct
  source 1..19: mol_type = other RNA
agtctgtcttcgatgacca

SEQ ID NO: 1049 - RNA, 19 nt, synthetic construct
  source 1..19: mol_type = other RNA
cgatgacccgcgtcgttga

SEQ ID NO: 1050 - RNA, 19 nt, synthetic construct
  source 1..19: mol_type = other RNA
tcgttggcgggctggtgga

SEQ ID NO: 1051 - RNA, 19 nt, synthetic construct
  source 1..19: mol_type = other RNA
tggtggcgctacgcgggga

SEQ ID NO: 1052 - RNA, 19 nt, synthetic construct
  source 1..19: mol_type = other RNA
tacgcggggcgcaccccta

SEQ ID NO: 1053 - RNA, 19 nt, synthetic construct
  source 1..19: mol_type = other RNA
acccctacatcgccgcgct

SEQ ID NO: 1054 - RNA, 19 nt, synthetic construct
  source 1..19: mol_type = other RNA
gccgcgctgtactggggca

SEQ ID NO: 1055 - RNA, 19 nt, synthetic construct
  source 1..19: mol_type = other RNA
ctggggccacagtttctga

SEQ ID NO: 1056 - RNA, 19 nt, synthetic construct
  source 1..19: mol_type = other RNA
tttctgcgccggcagccta

SEQ ID NO: 1057 - RNA, 19 nt, synthetic construct
  source 1..19: mol_type = other RNA
cggcagcctcatcgcccca

SEQ ID NO: 1058 - RNA, 19 nt, synthetic construct
  source 1..19: mol_type = other RNA
tcgccccctgctgggtgct

SEQ ID NO: 1059 - RNA, 19 nt, synthetic construct
  source 1..19: mol_type = other RNA
tgggtgctgacggccgcta

SEQ ID NO: 1060 - RNA, 19 nt, synthetic construct
  source 1..19: mol_type = other RNA
gccgctcactgcctgcaga

SEQ ID NO: 1061 - RNA, 19 nt, synthetic construct
  source 1..19: mol_type = other RNA
ctgcaggaccggcccgcaa

SEQ ID NO: 1062 - RNA, 19 nt, synthetic construct
  source 1..19: mol_type = other RNA
ggcccgcacccgaggatct

SEQ ID NO: 1063 - RNA, 19 nt, synthetic construct
  source 1..19: mol_type = other RNA
cgaggatctgacggtggta

SEQ ID NO: 1064 - RNA, 19 nt, synthetic construct
  source 1..19: mol_type = other RNA
gtggtgctcggccaggaaa

SEQ ID NO: 1065 - RNA, 19 nt, synthetic construct
  source 1..19: mol_type = other RNA
gccaggaacgccgtaacca

SEQ ID NO: 1066 - RNA, 19 nt, synthetic construct
  source 1..19: mol_type = other RNA
cgtaaccacagctgtgaga

SEQ ID NO: 1067 - RNA, 19 nt, synthetic construct
  source 1..19: mol_type = other RNA
tgtgagccgtgccagacgt

SEQ ID NO: 1068 - RNA, 19 nt, synthetic construct
  source 1..19: mol_type = other RNA
tgccagacgttggccgtga

SEQ ID NO: 1069 - RNA, 19 nt, synthetic construct
  source 1..19: mol_type = other RNA
gccgtgcgctcctaccgct

SEQ ID NO: 1070 - RNA, 19 nt, synthetic construct
  source 1..19: mol_type = other RNA
taccgcttgcacgaggcct

SEQ ID NO: 1071 - RNA, 19 nt, synthetic construct
  source 1..19: mol_type = other RNA
acgaggccttctcgcccgt

SEQ ID NO: 1072 - RNA, 19 nt, synthetic construct
  source 1..19: mol_type = other RNA
tcgcccgtcagctaccaga

SEQ ID NO: 1073 - RNA, 19 nt, synthetic construct
  source 1..19: mol_type = other RNA
ctaccagcacgacctggct

SEQ ID NO: 1074 - RNA, 19 nt, synthetic construct
  source 1..19: mol_type = other RNA
acctggctctgttgcgcct

SEQ ID NO: 1075 - RNA, 19 nt, synthetic construct
  source 1..19: mol_type = other RNA
ttgcgccttcaggaggata

SEQ ID NO: 1076 - RNA, 19 nt, synthetic construct
  source 1..19: mol_type = other RNA
gaggatgcggacggcagct

SEQ ID NO: 1077 - RNA, 19 nt, synthetic construct
  source 1..19: mol_type = other RNA
acggcagctgcgcgctcct

SEQ ID NO: 1078 - RNA, 19 nt, synthetic construct
  source 1..19: mol_type = other RNA
cgctcctgtcgccttacgt

SEQ ID NO: 1079 - RNA, 19 nt, synthetic construct
  source 1..19: mol_type = other RNA
ccttacgttcagccggtgt

SEQ ID NO: 1080 - RNA, 19 nt, synthetic construct
  source 1..19: mol_type = other RNA
agccggtgtgcctgccaaa

SEQ ID NO: 1081 - RNA, 19 nt, synthetic construct
  source 1..19: mol_type = other RNA
tgccaagcggcgccgcgca

SEQ ID NO: 1082 - RNA, 19 nt, synthetic construct
  source 1..19: mol_type = other RNA
gcgccgcgcgaccctccga

SEQ ID NO: 1083 - RNA, 19 nt, synthetic construct
  source 1..19: mol_type = other RNA
ccctccgagaccacgctct

SEQ ID NO: 1084 - RNA, 19 nt, synthetic construct
  source 1..19: mol_type = other RNA
cgctctgccaggtggccga

SEQ ID NO: 1085 - RNA, 19 nt, synthetic construct
  source 1..19: mol_type = other RNA
aggtggccggctggggcca

SEQ ID NO: 1086 - RNA, 19 nt, synthetic construct
  source 1..19: mol_type = other RNA
tggggccaccagttcgaga

SEQ ID NO: 1087 - RNA, 19 nt, synthetic construct
  source 1..19: mol_type = other RNA
ttcgagggggcggaggaat

SEQ ID NO: 1088 - RNA, 19 nt, synthetic construct
  source 1..19: mol_type = other RNA
cggaggaatatgccagctt

SEQ ID NO: 1089 - RNA, 19 nt, synthetic construct
  source 1..19: mol_type = other RNA
cagcttcctgcaggaggca

SEQ ID NO: 1090 - RNA, 19 nt, synthetic construct
  source 1..19: mol_type = other RNA
aggaggcgcaggtaccgtt

SEQ ID NO: 1091 - RNA, 19 nt, synthetic construct
  source 1..19: mol_type = other RNA
aggtaccgttcctctccct

SEQ ID NO: 1092 - RNA, 19 nt, synthetic construct
  source 1..19: mol_type = other RNA
ctctccctggagcgctgct

SEQ ID NO: 1093 - RNA, 19 nt, synthetic construct
  source 1..19: mol_type = other RNA
cgctgctcagccccggaca

SEQ ID NO: 1094 - RNA, 19 nt, synthetic construct
  source 1..19: mol_type = other RNA
ccggacgtgcacggatcct

SEQ ID NO: 1095 - RNA, 19 nt, synthetic construct
  source 1..19: mol_type = other RNA
cggatcctccatcctccca

SEQ ID NO: 1096 - RNA, 19 nt, synthetic construct
  source 1..19: mol_type = other RNA
catcctccccggcatgcta

SEQ ID NO: 1097 - RNA, 19 nt, synthetic construct
  source 1..19: mol_type = other RNA
catgctctgcgcagggtta

SEQ ID NO: 1098 - RNA, 19 nt, synthetic construct
  source 1..19: mol_type = other RNA
agggttcctcgagggcgga

SEQ ID NO: 1099 - RNA, 19 nt, synthetic construct
  source 1..19: mol_type = other RNA
gagggcggcaccgatgcgt

SEQ ID NO: 1100 - RNA, 19 nt, synthetic construct
  source 1..19: mol_type = other RNA
gatgcgtgccagggtgatt

SEQ ID NO: 1101 - RNA, 19 nt, synthetic construct
  source 1..19: mol_type = other RNA
agggtgattccggaggcca

SEQ ID NO: 1102 - RNA, 19 nt, synthetic construct
  source 1..19: mol_type = other RNA
cggaggcccgctggtgtgt

SEQ ID NO: 1103 - RNA, 19 nt, synthetic construct
  source 1..19: mol_type = other RNA
ggtgtgtgaggaccaagct

SEQ ID NO: 1104 - RNA, 19 nt, synthetic construct
  source 1..19: mol_type = other RNA
ccaagctgcagagcgccga

SEQ ID NO: 1105 - RNA, 19 nt, synthetic construct
  source 1..19: mol_type = other RNA
agagcgccggctcacccta

SEQ ID NO: 1106 - RNA, 19 nt, synthetic construct
  source 1..19: mol_type = other RNA
tcaccctgcaaggcatcat

SEQ ID NO: 1107 - RNA, 19 nt, synthetic construct
  source 1..19: mol_type = other RNA
ggcatcatcagctggggat

SEQ ID NO: 1108 - RNA, 19 nt, synthetic construct
  source 1..19: mol_type = other RNA
ctggggatcgggctgtggt

SEQ ID NO: 1109 - RNA, 19 nt, synthetic construct
  source 1..19: mol_type = other RNA
tgtggtgaccgcaacaaga

SEQ ID NO: 1110 - RNA, 19 nt, synthetic construct
  source 1..19: mol_type = other RNA
caacaagccaggcgtctaa

SEQ ID NO: 1111 - RNA, 19 nt, synthetic construct
  source 1..19: mol_type = other RNA
aggcgtctacaccgatgta

SEQ ID NO: 1112 - RNA, 19 nt, synthetic construct
  source 1..19: mol_type = other RNA
gatgtggcctactacctga

SEQ ID NO: 1113 - RNA, 19 nt, synthetic construct
  source 1..19: mol_type = other RNA
tactacctggcctggatca

SEQ ID NO: 1114 - RNA, 19 nt, synthetic construct
  source 1..19: mol_type = other RNA
ctggatccgggagcacaca

SEQ ID NO: 1115 - RNA, 19 nt, synthetic construct
  source 1..19: mol_type = other RNA
agcacaccgtttcctgatt

SEQ ID NO: 1116 - RNA, 19 nt, synthetic construct
  source 1..19: mol_type = other RNA
tcctgattgctcagggact

SEQ ID NO: 1117 - RNA, 19 nt, synthetic construct
  source 1..19: mol_type = other RNA
cagggactcatctttccct

SEQ ID NO: 1118 - RNA, 19 nt, synthetic construct
  source 1..19: mol_type = other RNA
tttccctccttggtgatta

SEQ ID NO: 1119 - RNA, 19 nt, synthetic construct
  source 1..19: mol_type = other RNA
tggtgattccgcagtgaga

SEQ ID NO: 1120 - RNA, 19 nt, synthetic construct
  source 1..19: mol_type = other RNA
agtgagagagtggctggga

SEQ ID NO: 1121 - RNA, 19 nt, synthetic construct
  source 1..19: mol_type = other RNA
gctggggcatggaaggcaa

SEQ ID NO: 1122 - RNA, 19 nt, synthetic construct
  source 1..19: mol_type = other RNA
tggaaggcaagattgtgta

SEQ ID NO: 1123 - RNA, 19 nt, synthetic construct
  source 1..19: mol_type = other RNA
ttgtgtcccattcccccaa

SEQ ID NO: 1124 - RNA, 19 nt, synthetic construct
  source 1..19: mol_type = other RNA
tcccccagtgcggccagct

SEQ ID NO: 1125 - RNA, 19 nt, synthetic construct
  source 1..19: mol_type = other RNA
gccagctccgcgccaggat

SEQ ID NO: 1126 - RNA, 19 nt, synthetic construct
  source 1..19: mol_type = other RNA
gccaggatggcgcaggaaa

SEQ ID NO: 1127 - RNA, 19 nt, synthetic construct
  source 1..19: mol_type = other RNA
gcaggaactcaataaagta

SEQ ID NO: 1128 - RNA, 19 nt, synthetic construct
  source 1..19: mol_type = other RNA
aataaagtgctttgaaaat

SEQ ID NO: 1129 - RNA, 19 nt, synthetic construct
  source 1..19: mol_type = other RNA
ttgaaaatgctgagaaaaa

SEQ ID NO: 1130 - RNA, 19 nt, synthetic construct
  source 1..19: mol_type = other RNA
agctgcctatccaggagtc

SEQ ID NO: 1131 - RNA, 19 nt, synthetic construct
  source 1..19: mol_type = other RNA
tcgttggtccagctgccta

SEQ ID NO: 1132 - RNA, 19 nt, synthetic construct
  source 1..19: mol_type = other RNA
atggcatccgtccgttggt

SEQ ID NO: 1133 - RNA, 19 nt, synthetic construct
  source 1..19: mol_type = other RNA
agcagagccctcatggcat

SEQ ID NO: 1134 - RNA, 19 nt, synthetic construct
  source 1..19: mol_type = other RNA
accccaggagcagcagagc

SEQ ID NO: 1135 - RNA, 19 nt, synthetic construct
  source 1..19: mol_type = other RNA
accagcaggaaccccagga

SEQ ID NO: 1136 - RNA, 19 nt, synthetic construct
  source 1..19: mol_type = other RNA
actccaagctcaccagcag

SEQ ID NO: 1137 - RNA, 19 nt, synthetic construct
  source 1..19: mol_type = other RNA
tgaaagtgttgactccaag

SEQ ID NO: 1138 - RNA, 19 nt, synthetic construct
  source 1..19: mol_type = other RNA
tcaaggtggaatcgaaagt

SEQ ID NO: 1139 - RNA, 19 nt, synthetic construct
  source 1..19: mol_type = other RNA
tgggggcttcccaaggtgg

SEQ ID NO: 1140 - RNA, 19 nt, synthetic construct
  source 1..19: mol_type = other RNA
acttatgctccttgggggc

SEQ ID NO: 1141 - RNA, 19 nt, synthetic construct
  source 1..19: mol_type = other RNA
tttcagctttgtacttatg

SEQ ID NO: 1142 - RNA, 19 nt, synthetic construct
  source 1..19: mol_type = other RNA
actgtgtgctcttcagctt

SEQ ID NO: 1143 - RNA, 19 nt, synthetic construct
  source 1..19: mol_type = other RNA
acagtgagaacgactgtgt

SEQ ID NO: 1144 - RNA, 19 nt, synthetic construct
  source 1..19: mol_type = other RNA
tccccggtgacagtgagaa

SEQ ID NO: 1145 - RNA, 19 nt, synthetic construct
  source 1..19: mol_type = other RNA
agtggcagggctccccggt

SEQ ID NO: 1146 - RNA, 19 nt, synthetic construct
  source 1..19: mol_type = other RNA
actggaaggggaagtggca

SEQ ID NO: 1147 - RNA, 19 nt, synthetic construct
  source 1..19: mol_type = other RNA
tctgccggtggtactggaa

SEQ ID NO: 1148 - RNA, 19 nt, synthetic construct
  source 1..19: mol_type = other RNA
ttgtggtacagctgccggt

SEQ ID NO: 1149 - RNA, 19 nt, synthetic construct
  source 1..19: mol_type = other RNA
tgtgggtacatttgtggta

SEQ ID NO: 1150 - RNA, 19 nt, synthetic construct
  source 1..19: mol_type = other RNA
tggccggcccttgtgggta

SEQ ID NO: 1151 - RNA, 19 nt, synthetic construct
  source 1..19: mol_type = other RNA
tgctgagggcctggccggc

SEQ ID NO: 1152 - RNA, 19 nt, synthetic construct
  source 1..19: mol_type = other RNA
ttagcacaccagggctgag

SEQ ID NO: 1153 - RNA, 19 nt, synthetic construct
  source 1..19: mol_type = other RNA
agttgggggtggtagcaca

SEQ ID NO: 1154 - RNA, 19 nt, synthetic construct
  source 1..19: mol_type = other RNA
tctgatcaaagttgggggt

SEQ ID NO: 1155 - RNA, 19 nt, synthetic construct
  source 1..19: mol_type = other RNA
tcccatcgctggtcctgat

SEQ ID NO: 1156 - RNA, 19 nt, synthetic construct
  source 1..19: mol_type = other RNA
aaacagtatccccatcgct

SEQ ID NO: 1157 - RNA, 19 nt, synthetic construct
  source 1..19: mol_type = other RNA
tcttgggctccaaacagta

SEQ ID NO: 1158 - RNA, 19 nt, synthetic construct
  source 1..19: mol_type = other RNA
tggtctttcactttcttgg

SEQ ID NO: 1159 - RNA, 19 nt, synthetic construct
  source 1..19: mol_type = other RNA
gtttgctgcagtggtcttt

SEQ ID NO: 1160 - RNA, 19 nt, synthetic construct
  source 1..19: mol_type = other RNA
aggggctgtgtttgctgca

SEQ ID NO: 1161 - RNA, 19 nt, synthetic construct
  source 1..19: mol_type = other RNA
ttcctttctggcaggggct

SEQ ID NO: 1162 - RNA, 19 nt, synthetic construct
  source 1..19: mol_type = other RNA
acacaggtccctcctttct

SEQ ID NO: 1163 - RNA, 19 nt, synthetic construct
  source 1..19: mol_type = other RNA
ttggcatgttcacacaggt

SEQ ID NO: 1164 - RNA, 19 nt, synthetic construct
  source 1..19: mol_type = other RNA
agtgggggccgcttggcat

SEQ ID NO: 1165 - RNA, 19 nt, synthetic construct
  source 1..19: mol_type = other RNA
tgacagagacagtgggggc

SEQ ID NO: 1166 - RNA, 19 nt, synthetic construct
  source 1..19: mol_type = other RNA
agtggtttccagtgaggtg

SEQ ID NO: 1167 - RNA, 19 nt, synthetic construct
  source 1..19: mol_type = other RNA
tctctttctggcagtggtt

SEQ ID NO: 1168 - RNA, 19 nt, synthetic construct
  source 1..19: mol_type = other RNA
taaagcacttctctttctg

SEQ ID NO: 1169 - RNA, 19 nt, synthetic construct
  source 1..19: mol_type = other RNA
taagctgaggctcaaagca

SEQ ID NO: 1170 - RNA, 19 nt, synthetic construct
  source 1..19: mol_type = other RNA
tgaaaaaccggagaagctg

SEQ ID NO: 1171 - RNA, 19 nt, synthetic construct
  source 1..19: mol_type = other RNA
tattcttgtggaaaaaccg

SEQ ID NO: 1172 - RNA, 19 nt, synthetic construct
  source 1..19: mol_type = other RNA
ataccatatctcattcttg

SEQ ID NO: 1173 - RNA, 19 nt, synthetic construct
  source 1..19: mol_type = other RNA
tgctcagttctataccata

SEQ ID NO: 1174 - RNA, 19 nt, synthetic construct
  source 1..19: mol_type = other RNA
tgccacagctgcttgctca

SEQ ID NO: 1175 - RNA, 19 nt, synthetic construct
  source 1..19: mol_type = other RNA
actggcatctggccacagc

SEQ ID NO: 1176 - RNA, 19 nt, synthetic construct
  source 1..19: mol_type = other RNA
aggacccttgcactggcat

SEQ ID NO: 1177 - RNA, 19 nt, synthetic construct
  source 1..19: mol_type = other RNA
agtgggcatcaggaccctt

SEQ ID NO: 1178 - RNA, 19 nt, synthetic construct
  source 1..19: mol_type = other RNA
tagccgctggcagtgggca

SEQ ID NO: 1179 - RNA, 19 nt, synthetic construct
  source 1..19: mol_type = other RNA
aggcctggctggccagccg

SEQ ID NO: 1180 - RNA, 19 nt, synthetic construct
  source 1..19: mol_type = other RNA
tggtgcggcaggcctggct

SEQ ID NO: 1181 - RNA, 19 nt, synthetic construct
  source 1..19: mol_type = other RNA
tgaggcacgggttggtgcg

SEQ ID NO: 1182 - RNA, 19 nt, synthetic construct
  source 1..19: mol_type = other RNA
agcgacccccatggaggca

SEQ ID NO: 1183 - RNA, 19 nt, synthetic construct
  source 1..19: mol_type = other RNA
acctctaggcagcgacccc

SEQ ID NO: 1184 - RNA, 19 nt, synthetic construct
  source 1..19: mol_type = other RNA
tgtggccctccacctctag

SEQ ID NO: 1185 - RNA, 19 nt, synthetic construct
  source 1..19: mol_type = other RNA
tggcacaggcggtggccct

SEQ ID NO: 1186 - RNA, 19 nt, synthetic construct
  source 1..19: mol_type = other RNA
tccaccgggcagtggcaca

SEQ ID NO: 1187 - RNA, 19 nt, synthetic construct
  source 1..19: mol_type = other RNA
tctccggtgtagcccaccg

SEQ ID NO: 1188 - RNA, 19 nt, synthetic construct
  source 1..19: mol_type = other RNA
tgtcgcagaaggctccggt

SEQ ID NO: 1189 - RNA, 19 nt, synthetic construct
  source 1..19: mol_type = other RNA
tggtgtccacgtcgcagaa

SEQ ID NO: 1190 - RNA, 19 nt, synthetic construct
  source 1..19: mol_type = other RNA
agcagcttgccttggtgtc

SEQ ID NO: 1191 - RNA, 19 nt, synthetic construct
  source 1..19: mol_type = other RNA
tggccatcatagcagcttg

SEQ ID NO: 1192 - RNA, 19 nt, synthetic construct
  source 1..19: mol_type = other RNA
agctgagcccgcggccatc

SEQ ID NO: 1193 - RNA, 19 nt, synthetic construct
  source 1..19: mol_type = other RNA
tccaggccgcggtagctga

SEQ ID NO: 1194 - RNA, 19 nt, synthetic construct
  source 1..19: mol_type = other RNA
tgtggtcctggccaggccg

SEQ ID NO: 1195 - RNA, 19 nt, synthetic construct
  source 1..19: mol_type = other RNA
tacccgagagcgtggtcct

SEQ ID NO: 1196 - RNA, 19 nt, synthetic construct
  source 1..19: mol_type = other RNA
tctgacagggcgcacccga

SEQ ID NO: 1197 - RNA, 19 nt, synthetic construct
  source 1..19: mol_type = other RNA
tgaggcccacggctgacag

SEQ ID NO: 1198 - RNA, 19 nt, synthetic construct
  source 1..19: mol_type = other RNA
aggtggcctccgaggccca

SEQ ID NO: 1199 - RNA, 19 nt, synthetic construct
  source 1..19: mol_type = other RNA
ttcacgttccggtaggtgg

SEQ ID NO: 1200 - RNA, 19 nt, synthetic construct
  source 1..19: mol_type = other RNA
tttgctcggcagtcacgtt

SEQ ID NO: 1201 - RNA, 19 nt, synthetic construct
  source 1..19: mol_type = other RNA
tcagttccgcgcttgctcg

SEQ ID NO: 1202 - RNA, 19 nt, synthetic construct
  source 1..19: mol_type = other RNA
tgcccagtccccagttccg

SEQ ID NO: 1203 - RNA, 19 nt, synthetic construct
  source 1..19: mol_type = other RNA
aaggcgtggccgcccagtc

SEQ ID NO: 1204 - RNA, 19 nt, synthetic construct
  source 1..19: mol_type = other RNA
tggttccggcagaaggcgt

SEQ ID NO: 1205 - RNA, 19 nt, synthetic construct
  source 1..19: mol_type = other RNA
tgtcgttgtccgggttccg

SEQ ID NO: 1206 - RNA, 19 nt, synthetic construct
  source 1..19: mol_type = other RNA
accacgggcggatgtcgtt

SEQ ID NO: 1207 - RNA, 19 nt, synthetic construct
  source 1..19: mol_type = other RNA
agcacgaagcaccacgggc

SEQ ID NO: 1208 - RNA, 19 nt, synthetic construct
  source 1..19: mol_type = other RNA
tgtcgcggttcagcacgaa

SEQ ID NO: 1209 - RNA, 19 nt, synthetic construct
  source 1..19: mol_type = other RNA
tagctcagccggtcgcggt

SEQ ID NO: 1210 - RNA, 19 nt, synthetic construct
  source 1..19: mol_type = other RNA
tgcagtactcccagctcag

SEQ ID NO: 1211 - RNA, 19 nt, synthetic construct
  source 1..19: mol_type = other RNA
actgtgccaggtcgcagta

SEQ ID NO: 1212 - RNA, 19 nt, synthetic construct
  source 1..19: mol_type = other RNA
tgggtctggcactgtgcca

SEQ ID NO: 1213 - RNA, 19 nt, synthetic construct
  source 1..19: mol_type = other RNA
tccgcctgggttggggtct

SEQ ID NO: 1214 - RNA, 19 nt, synthetic construct
  source 1..19: mol_type = other RNA
tgggtcggaggcgccgcct

SEQ ID NO: 1215 - RNA, 19 nt, synthetic construct
  source 1..19: mol_type = other RNA
aggggacaccggggtcgga

SEQ ID NO: 1216 - RNA, 19 nt, synthetic construct
  source 1..19: mol_type = other RNA
acatgaagcctaggggaca

SEQ ID NO: 1217 - RNA, 19 nt, synthetic construct
  source 1..19: mol_type = other RNA
tgcatgagtgggacatgaa

SEQ ID NO: 1218 - RNA, 19 nt, synthetic construct
  source 1..19: mol_type = other RNA
tggctgcgcgggcatgagt

SEQ ID NO: 1219 - RNA, 19 nt, synthetic construct
  source 1..19: mol_type = other RNA
ttcggcggtgccggctgcg

SEQ ID NO: 1220 - RNA, 19 nt, synthetic construct
  source 1..19: mol_type = other RNA
tggctgaggcttcggcggt

SEQ ID NO: 1221 - RNA, 19 nt, synthetic construct
  source 1..19: mol_type = other RNA
tgtccgggtcgtgggctga

SEQ ID NO: 1222 - RNA, 19 nt, synthetic construct
  source 1..19: mol_type = other RNA
actgaggcggggtccgggt

SEQ ID NO: 1223 - RNA, 19 nt, synthetic construct
  source 1..19: mol_type = other RNA
tcggggtctgggactgagg

SEQ ID NO: 1224 - RNA, 19 nt, synthetic construct
  source 1..19: mol_type = other RNA
tgcaaggctcccggggtct

SEQ ID NO: 1225 - RNA, 19 nt, synthetic construct
  source 1..19: mol_type = other RNA
tcccgcttcgccggcaagg

SEQ ID NO: 1226 - RNA, 19 nt, synthetic construct
  source 1..19: mol_type = other RNA
aaggcggctgctcccgctt

SEQ ID NO: 1227 - RNA, 19 nt, synthetic construct
  source 1..19: mol_type = other RNA
ttggtcagggaaggcggct

SEQ ID NO: 1228 - RNA, 19 nt, synthetic construct
  source 1..19: mol_type = other RNA
agtgggccgttcctggtca

SEQ ID NO: 1229 - RNA, 19 nt, synthetic construct
  source 1..19: mol_type = other RNA
tccgcagctcagtgggccg

SEQ ID NO: 1230 - RNA, 19 nt, synthetic construct
  source 1..19: mol_type = other RNA
tgcggagccgctgcccgca

SEQ ID NO: 1231 - RNA, 19 nt, synthetic construct
  source 1..19: mol_type = other RNA
acagactcttgcggagccg

SEQ ID NO: 1232 - RNA, 19 nt, synthetic construct
  source 1..19: mol_type = other RNA
tggtcatcgaagacagact

SEQ ID NO: 1233 - RNA, 19 nt, synthetic construct
  source 1..19: mol_type = other RNA
tcaacgacgcgggtcatcg

SEQ ID NO: 1234 - RNA, 19 nt, synthetic construct
  source 1..19: mol_type = other RNA
tccaccagcccgccaacga

SEQ ID NO: 1235 - RNA, 19 nt, synthetic construct
  source 1..19: mol_type = other RNA
tccccgcgtagcgccacca

SEQ ID NO: 1236 - RNA, 19 nt, synthetic construct
  source 1..19: mol_type = other RNA
taggggtgcgccccgcgta

SEQ ID NO: 1237 - RNA, 19 nt, synthetic construct
  source 1..19: mol_type = other RNA
agcgcggcgatgtaggggt

SEQ ID NO: 1238 - RNA, 19 nt, synthetic construct
  source 1..19: mol_type = other RNA
tgccccagtacagcgcggc

SEQ ID NO: 1239 - RNA, 19 nt, synthetic construct
  source 1..19: mol_type = other RNA
tcagaaactgtggccccag

SEQ ID NO: 1240 - RNA, 19 nt, synthetic construct
  source 1..19: mol_type = other RNA
taggctgccggcgcagaaa

SEQ ID NO: 1241 - RNA, 19 nt, synthetic construct
  source 1..19: mol_type = other RNA
tggggcgatgaggctgccg

SEQ ID NO: 1242 - RNA, 19 nt, synthetic construct
  source 1..19: mol_type = other RNA
agcacccagcagggggcga

SEQ ID NO: 1243 - RNA, 19 nt, synthetic construct
  source 1..19: mol_type = other RNA
tagcggccgtcagcaccca

SEQ ID NO: 1244 - RNA, 19 nt, synthetic construct
  source 1..19: mol_type = other RNA
tctgcaggcagtgagcggc

SEQ ID NO: 1245 - RNA, 19 nt, synthetic construct
  source 1..19: mol_type = other RNA
ttgcgggccggtcctgcag

SEQ ID NO: 1246 - RNA, 19 nt, synthetic construct
  source 1..19: mol_type = other RNA
agatcctcgggtgcgggcc

SEQ ID NO: 1247 - RNA, 19 nt, synthetic construct
  source 1..19: mol_type = other RNA
taccaccgtcagatcctcg

SEQ ID NO: 1248 - RNA, 19 nt, synthetic construct
  source 1..19: mol_type = other RNA
tttcctggccgagcaccac

SEQ ID NO: 1249 - RNA, 19 nt, synthetic construct
  source 1..19: mol_type = other RNA
tggttacggcgttcctggc

SEQ ID NO: 1250 - RNA, 19 nt, synthetic construct
  source 1..19: mol_type = other RNA
tctcacagctgtggttacg

SEQ ID NO: 1251 - RNA, 19 nt, synthetic construct
  source 1..19: mol_type = other RNA
acgtctggcacggctcaca

SEQ ID NO: 1252 - RNA, 19 nt, synthetic construct
  source 1..19: mol_type = other RNA
tcacggccaacgtctggca

SEQ ID NO: 1253 - RNA, 19 nt, synthetic construct
  source 1..19: mol_type = other RNA
agcggtaggagcgcacggc

SEQ ID NO: 1254 - RNA, 19 nt, synthetic construct
  source 1..19: mol_type = other RNA
aggcctcgtgcaagcggta

SEQ ID NO: 1255 - RNA, 19 nt, synthetic construct
  source 1..19: mol_type = other RNA
acgggcgagaaggcctcgt

SEQ ID NO: 1256 - RNA, 19 nt, synthetic construct
  source 1..19: mol_type = other RNA
tctggtagctgacgggcga

SEQ ID NO: 1257 - RNA, 19 nt, synthetic construct
  source 1..19: mol_type = other RNA
agccaggtcgtgctggtag

SEQ ID NO: 1258 - RNA, 19 nt, synthetic construct
  source 1..19: mol_type = other RNA
aggcgcaacagagccaggt

SEQ ID NO: 1259 - RNA, 19 nt, synthetic construct
  source 1..19: mol_type = other RNA
tatcctcctgaaggcgcaa

SEQ ID NO: 1260 - RNA, 19 nt, synthetic construct
  source 1..19: mol_type = other RNA
agctgccgtccgcatcctc

SEQ ID NO: 1261 - RNA, 19 nt, synthetic construct
  source 1..19: mol_type = other RNA
aggagcgcgcagctgccgt

SEQ ID NO: 1262 - RNA, 19 nt, synthetic construct
  source 1..19: mol_type = other RNA
acgtaaggcgacaggagcg

SEQ ID NO: 1263 - RNA, 19 nt, synthetic construct
  source 1..19: mol_type = other RNA
acaccggctgaacgtaagg

SEQ ID NO: 1264 - RNA, 19 nt, synthetic construct
  source 1..19: mol_type = other RNA
tttggcaggcacaccggct

SEQ ID NO: 1265 - RNA, 19 nt, synthetic construct
  source 1..19: mol_type = other RNA
tgcgcggcgccgcttggca

SEQ ID NO: 1266 - RNA, 19 nt, synthetic construct
  source 1..19: mol_type = other RNA
tcggagggtcgcgcggcgc

SEQ ID NO: 1267 - RNA, 19 nt, synthetic construct
  source 1..19: mol_type = other RNA
agagcgtggtctcggaggg

SEQ ID NO: 1268 - RNA, 19 nt, synthetic construct
  source 1..19: mol_type = other RNA
tcggccacctggcagagcg

SEQ ID NO: 1269 - RNA, 19 nt, synthetic construct
  source 1..19: mol_type = other RNA
tggccccagccggccacct

SEQ ID NO: 1270 - RNA, 19 nt, synthetic construct
  source 1..19: mol_type = other RNA
tctcgaactggtggcccca

SEQ ID NO: 1271 - RNA, 19 nt, synthetic construct
  source 1..19: mol_type = other RNA
attcctccgccccctcgaa

SEQ ID NO: 1272 - RNA, 19 nt, synthetic construct
  source 1..19: mol_type = other RNA
aagctggcatattcctccg

SEQ ID NO: 1273 - RNA, 19 nt, synthetic construct
  source 1..19: mol_type = other RNA
tgcctcctgcaggaagctg

SEQ ID NO: 1274 - RNA, 19 nt, synthetic construct
  source 1..19: mol_type = other RNA
aacggtacctgcgcctcct

SEQ ID NO: 1275 - RNA, 19 nt, synthetic construct
  source 1..19: mol_type = other RNA
agggagaggaacggtacct

SEQ ID NO: 1276 - RNA, 19 nt, synthetic construct
  source 1..19: mol_type = other RNA
agcagcgctccagggagag

SEQ ID NO: 1277 - RNA, 19 nt, synthetic construct
  source 1..19: mol_type = other RNA
tgtccggggctgagcagcg

SEQ ID NO: 1278 - RNA, 19 nt, synthetic construct
  source 1..19: mol_type = other RNA
aggatccgtgcacgtccgg

SEQ ID NO: 1279 - RNA, 19 nt, synthetic construct
  source 1..19: mol_type = other RNA
tgggaggatggaggatccg

SEQ ID NO: 1280 - RNA, 19 nt, synthetic construct
  source 1..19: mol_type = other RNA
tagcatgccggggaggatg

SEQ ID NO: 1281 - RNA, 19 nt, synthetic construct
  source 1..19: mol_type = other RNA
taaccctgcgcagagcatg

SEQ ID NO: 1282 - RNA, 19 nt, synthetic construct
  source 1..19: mol_type = other RNA
tccgccctcgaggaaccct

SEQ ID NO: 1283 - RNA, 19 nt, synthetic construct
  source 1..19: mol_type = other RNA
acgcatcggtgccgccctc

SEQ ID NO: 1284 - RNA, 19 nt, synthetic construct
  source 1..19: mol_type = other RNA
aatcaccctggcacgcatc

SEQ ID NO: 1285 - RNA, 19 nt, synthetic construct
  source 1..19: mol_type = other RNA
tggcctccggaatcaccct

SEQ ID NO: 1286 - RNA, 19 nt, synthetic construct
  source 1..19: mol_type = other RNA
acacaccagcgggcctccg

SEQ ID NO: 1287 - RNA, 19 nt, synthetic construct
  source 1..19: mol_type = other RNA
agcttggtcctcacacacc

SEQ ID NO: 1288 - RNA, 19 nt, synthetic construct
  source 1..19: mol_type = other RNA
tcggcgctctgcagcttgg

SEQ ID NO: 1289 - RNA, 19 nt, synthetic construct
  source 1..19: mol_type = other RNA
tagggtgagccggcgctct

SEQ ID NO: 1290 - RNA, 19 nt, synthetic construct
  source 1..19: mol_type = other RNA
atgatgccttgcagggtga

SEQ ID NO: 1291 - RNA, 19 nt, synthetic construct
  source 1..19: mol_type = other RNA
atccccagctgatgatgcc

SEQ ID NO: 1292 - RNA, 19 nt, synthetic construct
  source 1..19: mol_type = other RNA
accacagcccgatccccag

SEQ ID NO: 1293 - RNA, 19 nt, synthetic construct
  source 1..19: mol_type = other RNA
tcttgttgcggtcaccaca

SEQ ID NO: 1294 - RNA, 19 nt, synthetic construct
  source 1..19: mol_type = other RNA
ttagacgcctggcttgttg

SEQ ID NO: 1295 - RNA, 19 nt, synthetic construct
  source 1..19: mol_type = other RNA
tacatcggtgtagacgcct

SEQ ID NO: 1296 - RNA, 19 nt, synthetic construct
  source 1..19: mol_type = other RNA
tcaggtagtaggccacatc

SEQ ID NO: 1297 - RNA, 19 nt, synthetic construct
  source 1..19: mol_type = other RNA
tgatccaggccaggtagta

SEQ ID NO: 1298 - RNA, 19 nt, synthetic construct
  source 1..19: mol_type = other RNA
tgtgtgctcccggatccag

SEQ ID NO: 1299 - RNA, 19 nt, synthetic construct
  source 1..19: mol_type = other RNA
aatcaggaaacggtgtgct

SEQ ID NO: 1300 - RNA, 19 nt, synthetic construct
  source 1..19: mol_type = other RNA
agtccctgagcaatcagga

SEQ ID NO: 1301 - RNA, 19 nt, synthetic construct
  source 1..19: mol_type = other RNA
agggaaagatgagtccctg

SEQ ID NO: 1302 - RNA, 19 nt, synthetic construct
  source 1..19: mol_type = other RNA
taatcaccaaggagggaaa

SEQ ID NO: 1303 - RNA, 19 nt, synthetic construct
  source 1..19: mol_type = other RNA
tctcactgcggaatcacca

SEQ ID NO: 1304 - RNA, 19 nt, synthetic construct
  source 1..19: mol_type = other RNA
tcccagccactctctcact

SEQ ID NO: 1305 - RNA, 19 nt, synthetic construct
  source 1..19: mol_type = other RNA
ttgccttccatgccccagc

SEQ ID NO: 1306 - RNA, 19 nt, synthetic construct
  source 1..19: mol_type = other RNA
tacacaatcttgccttcca

SEQ ID NO: 1307 - RNA, 19 nt, synthetic construct
  source 1..19: mol_type = other RNA
ttgggggaatgggacacaa

SEQ ID NO: 1308 - RNA, 19 nt, synthetic construct
  source 1..19: mol_type = other RNA
agctggccgcactggggga

SEQ ID NO: 1309 - RNA, 19 nt, synthetic construct
  source 1..19: mol_type = other RNA
atcctggcgcggagctggc

SEQ ID NO: 1310 - RNA, 19 nt, synthetic construct
  source 1..19: mol_type = other RNA
tttcctgcgccatcctggc

SEQ ID NO: 1311 - RNA, 19 nt, synthetic construct
  source 1..19: mol_type = other RNA
tactttattgagttcctgc

SEQ ID NO: 1312 - RNA, 19 nt, synthetic construct
  source 1..19: mol_type = other RNA
attttcaaagcactttatt

SEQ ID NO: 1313 - RNA, 19 nt, synthetic construct
  source 1..19: mol_type = other RNA
tttttctcagcattttcaa

SEQ ID NO: 1314 - DNA, 21 bp, synthetic construct
  source 1..21: mol_type = other DNA
  modified_base 1: mod_base = OTHER; note = guanosine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = uridine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
gactcctggataggcagcttt

SEQ ID NO: 1315 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
taggcagctggaccaacgatt

SEQ ID NO: 1316 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = adenosine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = uridine-3'-phosphate
  misc_feature 1..19: note = RNA
  misc_feature 20..21: note = DNA
accaacggacggatgccattt

SEQ ID NO: 1317 - DNA, 21 bp, synthetic construct
  source 1..21: mol_type = other DNA
  modified_base 1: mod_base = OTHER; note = adenosine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
atgccatgagggctctgcttt

SEQ ID NO: 1318 - DNA, 21 bp, synthetic construct
  source 1..21: mol_type = other DNA
  modified_base 1: mod_base = OTHER; note = guanosine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
gctctgctgctcctggggttt

SEQ ID NO: 1319 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
tcctggggttcctgctggttt

SEQ ID NO: 1320 - DNA, 21 bp, synthetic construct
  source 1..21: mol_type = other DNA
  modified_base 1: mod_base = OTHER; note = cytidine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
ctgctggtgagcttggagttt

SEQ ID NO: 1321 - DNA, 21 bp, synthetic construct
  source 1..21: mol_type = other DNA
  modified_base 1: mod_base = OTHER; note = cytidine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = uridine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
cttggagtcaacactttcatt

SEQ ID NO: 1322 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
actttcgattccaccttgatt

SEQ ID NO: 1323 - DNA, 21 bp, synthetic construct
  source 1..21: mol_type = other DNA
  modified_base 1: mod_base = OTHER; note = cytidine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
ccaccttgggaagcccccatt

SEQ ID NO: 1324 - DNA, 21 bp, synthetic construct
  source 1..21: mol_type = other DNA
  modified_base 1: mod_base = OTHER; note = guanosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = uridine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
gcccccaaggagcataagttt

SEQ ID NO: 1325 - DNA, 21 bp, synthetic construct
  source 1..21: mol_type = other DNA
  modified_base 1: mod_base = OTHER; note = cytidine-3'-phosphate
  modified_base 2: mod_base = OTHER; note = adenosine-3'-phosphate
  modified_base 3: mod_base = OTHER; note = uridine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
cataagtacaaagctgaaatt

SEQ ID NO: 1326 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
aagctgaagagcacacagttt

SEQ ID NO: 1327 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = uridine-3'-phosphate
  modified_base 11: mod_base = OTHER; note = uridine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
acacagtcgttctcactgttt

SEQ ID NO: 1328 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
ttctcactgtcaccggggatt

SEQ ID NO: 1329 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
accggggagccctgccacttt

SEQ ID NO: 1330 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
tgccacttccccttccagttt

SEQ ID NO: 1331 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
ttccagtaccaccggcagatt

SEQ ID NO: 1332 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
accggcagctgtaccacaatt

SEQ ID NO: 1333 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = adenosine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
taccacaaatgtacccacatt

SEQ ID NO: 1334 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tacccacaagggccggccatt

SEQ ID NO: 1335 - DNA, 21 bp, synthetic construct
  source 1..21: mol_type = other DNA
  modified_base 1: mod_base = OTHER; note = guanosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
gccggccaggccctcagcatt

SEQ ID NO: 1336 - DNA, 21 bp, synthetic construct
  source 1..21: mol_type = other DNA
  modified_base 1: mod_base = OTHER; note = cytidine-3'-phosphate
  modified_base 2: mod_base = OTHER; note = uridine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
ctcagccctggtgtgctaatt

SEQ ID NO: 1337 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tgtgctaccacccccaacttt

SEQ ID NO: 1338 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = uridine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
acccccaactttgatcagatt

SEQ ID NO: 1339 - DNA, 21 bp, synthetic construct
  source 1..21: mol_type = other DNA
  modified_base 1: mod_base = OTHER; note = adenosine-3'-phosphate
  modified_base 2: mod_base = OTHER; note = uridine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
atcaggaccagcgatgggatt

SEQ ID NO: 1340 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = uridine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = uridine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
agcgatggggatactgttttt

SEQ ID NO: 1341 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
tactgtttggagcccaagatt

SEQ ID NO: 1342 - DNA, 21 bp, synthetic construct
  source 1..21: mol_type = other DNA
  modified_base 1: mod_base = OTHER; note = cytidine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
ccaagaaagtgaaagaccatt

SEQ ID NO: 1343 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = cytidine-3'-phosphate
  misc_feature 1..19: note = RNA
  misc_feature 20..21: note = DNA
aaagaccactgcagcaaactt

SEQ ID NO: 1344 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = adenosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tgcagcaaacacagccccttt

SEQ ID NO: 1345 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
agcccctgccagaaaggaatt

SEQ ID NO: 1346 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
agaaaggagggacctgtgttt

SEQ ID NO: 1347 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
acctgtgtgaacatgccaatt

SEQ ID NO: 1348 - DNA, 21 bp, synthetic construct
  source 1..21: mol_type = other DNA
  modified_base 1: mod_base = OTHER; note = adenosine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
atgccaagcggcccccacttt

SEQ ID NO: 1349 - DNA, 21 bp, synthetic construct
  source 1..21: mol_type = other DNA
  modified_base 1: mod_base = OTHER; note = guanosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = uridine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
gcccccactgtctctgtcatt

SEQ ID NO: 1350 - DNA, 21 bp, synthetic construct
  source 1..21: mol_type = other DNA
  modified_base 1: mod_base = OTHER; note = cytidine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
cacctcactggaaaccacttt

SEQ ID NO: 1351 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
aaccactgccagaaagagatt

SEQ ID NO: 1352 - DNA, 21 bp, synthetic construct
  source 1..21: mol_type = other DNA
  modified_base 1: mod_base = OTHER; note = cytidine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = uridine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
cagaaagagaagtgctttatt

SEQ ID NO: 1353 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
tgctttgagcctcagcttatt

SEQ ID NO: 1354 - DNA, 21 bp, synthetic construct
  source 1..21: mol_type = other DNA
  modified_base 1: mod_base = OTHER; note = cytidine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = uridine-3'-phosphate
  modified_base 16: mod_base = OTHER; note = uridine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
cagcttctccggtttttcatt

SEQ ID NO: 1355 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
cggtttttccacaagaatatt

SEQ ID NO: 1356 - DNA, 21 bp, synthetic construct
  source 1..21: mol_type = other DNA
  modified_base 1: mod_base = OTHER; note = cytidine-3'-phosphate
  modified_base 2: mod_base = OTHER; note = adenosine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = adenosine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = uridine-3'-phosphate
  modified_base 13: mod_base = OTHER; note = adenosine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = uridine-3'-phosphate
  modified_base 18: mod_base = OTHER; note = adenosine-3'-phosphate
  modified_base 19: mod_base = OTHER; note = uridine-3'-phosphate
  misc_feature 1..19: note = RNA
  misc_feature 20..21: note = DNA
caagaatgagatatggtattt

SEQ ID NO: 1357 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = adenosine-3'-phosphate
  modified_base 8: mod_base = OTHER; note = uridine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tatggtatagaactgagcatt

SEQ ID NO: 1358 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tgagcaagcagctgtggcatt

SEQ ID NO: 1359 - DNA, 21 bp, synthetic construct
  source 1..21: mol_type = other DNA
  modified_base 1: mod_base = OTHER; note = guanosine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
gctgtggccagatgccagttt

SEQ ID NO: 1360 - DNA, 21 bp, synthetic construct
  source 1..21: mol_type = other DNA
  modified_base 1: mod_base = OTHER; note = adenosine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = uridine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
atgccagtgcaagggtccttt

SEQ ID NO: 1361 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
aagggtcctgatgcccacttt

SEQ ID NO: 1362 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
tgcccactgccagcggctatt

SEQ ID NO: 1363 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
cggctggccagccaggccttt

SEQ ID NO: 1364 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
agccaggcctgccgcaccatt

SEQ ID NO: 1365 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
cgcaccaacccgtgcctcatt

SEQ ID NO: 1366 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tgcctccatgggggtcgcttt

SEQ ID NO: 1367 - DNA, 21 bp, synthetic construct
  source 1..21: mol_type = other DNA
  modified_base 1: mod_base = OTHER; note = guanosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
ggggtcgctgcctagaggttt

SEQ ID NO: 1368 - DNA, 21 bp, synthetic construct
  source 1..21: mol_type = other DNA
  modified_base 1: mod_base = OTHER; note = cytidine-3'-phosphate
  modified_base 2: mod_base = OTHER; note = uridine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
ctagaggtggagggccacatt

SEQ ID NO: 1369 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
agggccaccgcctgtgccatt

SEQ ID NO: 1370 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
tgtgccactgcccggtggatt

SEQ ID NO: 1371 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = adenosine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
cggtgggctacaccggagatt

SEQ ID NO: 1372 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = uridine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
accggagccttctgcgacatt

SEQ ID NO: 1373 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = uridine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
ttctgcgacgtggacaccatt

SEQ ID NO: 1374 - DNA, 21 bp, synthetic construct
  source 1..21: mol_type = other DNA
  modified_base 1: mod_base = OTHER; note = guanosine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
gacaccaaggcaagctgcttt

SEQ ID NO: 1375 - DNA, 21 bp, synthetic construct
  source 1..21: mol_type = other DNA
  modified_base 1: mod_base = OTHER; note = cytidine-3'-phosphate
  modified_base 2: mod_base = OTHER; note = adenosine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = adenosine-3'-phosphate
  modified_base 11: mod_base = OTHER; note = uridine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
caagctgctatgatggccatt

SEQ ID NO: 1376 - DNA, 21 bp, synthetic construct
  source 1..21: mol_type = other DNA
  modified_base 1: mod_base = OTHER; note = guanosine-3'-phosphate
  modified_base 2: mod_base = OTHER; note = adenosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
gatggccgcgggctcagcttt

SEQ ID NO: 1377 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
tcagctaccgcggcctggatt

SEQ ID NO: 1378 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
cggcctggccaggaccacatt

SEQ ID NO: 1379 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
aggaccacgctctcgggtatt

SEQ ID NO: 1380 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
tcgggtgcgccctgtcagatt

SEQ ID NO: 1381 - DNA, 21 bp, synthetic construct
  source 1..21: mol_type = other DNA
  modified_base 1: mod_base = OTHER; note = cytidine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = uridine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
ctgtcagccgtgggcctcatt

SEQ ID NO: 1382 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tgggcctcggaggccaccttt

SEQ ID NO: 1383 - DNA, 21 bp, synthetic construct
  source 1..21: mol_type = other DNA
  modified_base 1: mod_base = OTHER; note = cytidine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
ccacctaccggaacgtgaatt

SEQ ID NO: 1384 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
aacgtgactgccgagcaaatt

SEQ ID NO: 1385 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
cgagcaagcgcggaactgatt

SEQ ID NO: 1386 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
cggaactggggactgggcatt

SEQ ID NO: 1387 - DNA, 21 bp, synthetic construct
  source 1..21: mol_type = other DNA
  modified_base 1: mod_base = OTHER; note = guanosine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
gactgggcggccacgcctttt

SEQ ID NO: 1388 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
acgccttctgccggaaccatt

SEQ ID NO: 1389 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
cggaacccggacaacgacatt

SEQ ID NO: 1390 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
aacgacatccgcccgtggttt

SEQ ID NO: 1391 - DNA, 21 bp, synthetic construct
  source 1..21: mol_type = other DNA
  modified_base 1: mod_base = OTHER; note = guanosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
gcccgtggtgcttcgtgcttt

SEQ ID NO: 1392 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
ttcgtgctgaaccgcgacatt

SEQ ID NO: 1393 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
accgcgaccggctgagctatt

SEQ ID NO: 1394 - DNA, 21 bp, synthetic construct
  source 1..21: mol_type = other DNA
  modified_base 1: mod_base = OTHER; note = cytidine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
ctgagctgggagtactgcatt

SEQ ID NO: 1395 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
tactgcgacctggcacagttt

SEQ ID NO: 1396 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tggcacagtgccagacccatt

SEQ ID NO: 1397 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = adenosine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
agaccccaacccaggcggatt

SEQ ID NO: 1398 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
aggcggcgcctccgacccatt

SEQ ID NO: 1399 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tccgaccccggtgtccccttt

SEQ ID NO: 1400 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
tgtcccctaggcttcatgttt

SEQ ID NO: 1401 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
ttcatgtcccactcatgcatt

SEQ ID NO: 1402 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
actcatgcccgcgcagccatt

SEQ ID NO: 1403 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
cgcagccggcaccgccgaatt

SEQ ID NO: 1404 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
accgccgaagcctcagccatt

SEQ ID NO: 1405 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tcagcccacgacccggacatt

SEQ ID NO: 1406 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
acccggaccccgcctcagttt

SEQ ID NO: 1407 - DNA, 21 bp, synthetic construct
  source 1..21: mol_type = other DNA
  modified_base 1: mod_base = OTHER; note = cytidine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
cctcagtcccagaccccgatt

SEQ ID NO: 1408 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
agaccccgggagccttgcatt

SEQ ID NO: 1409 - DNA, 21 bp, synthetic construct
  source 1..21: mol_type = other DNA
  modified_base 1: mod_base = OTHER; note = cytidine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
ccttgccggcgaagcgggatt

SEQ ID NO: 1410 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
aagcgggagcagccgcctttt

SEQ ID NO: 1411 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
agccgccttccctgaccaatt

SEQ ID NO: 1412 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tgaccaggaacggcccacttt

SEQ ID NO: 1413 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
cggcccactgagctgcggatt

SEQ ID NO: 1414 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tgcgggcagcggctccgcatt

SEQ ID NO: 1415 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
cggctccgcaagagtctgttt

SEQ ID NO: 1416 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
agtctgtcttcgatgaccatt

SEQ ID NO: 1417 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = uridine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
cgatgacccgcgtcgttgatt

SEQ ID NO: 1418 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
tcgttggcgggctggtggatt

SEQ ID NO: 1419 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
tggtggcgctacgcggggatt

SEQ ID NO: 1420 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
tacgcggggcgcacccctatt

SEQ ID NO: 1421 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = adenosine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
acccctacatcgccgcgcttt

SEQ ID NO: 1422 - DNA, 21 bp, synthetic construct
  source 1..21: mol_type = other DNA
  modified_base 1: mod_base = OTHER; note = guanosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = uridine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
gccgcgctgtactggggcatt

SEQ ID NO: 1423 - DNA, 21 bp, synthetic construct
  source 1..21: mol_type = other DNA
  modified_base 1: mod_base = OTHER; note = cytidine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = adenosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
ctggggccacagtttctgatt

SEQ ID NO: 1424 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
tttctgcgccggcagcctatt

SEQ ID NO: 1425 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
cggcagcctcatcgccccatt

SEQ ID NO: 1426 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tcgccccctgctgggtgcttt

SEQ ID NO: 1427 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
tgggtgctgacggccgctatt

SEQ ID NO: 1428 - DNA, 21 bp, synthetic construct
  source 1..21: mol_type = other DNA
  modified_base 1: mod_base = OTHER; note = guanosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
gccgctcactgcctgcagatt

SEQ ID NO: 1429 - DNA, 21 bp, synthetic construct
  source 1..21: mol_type = other DNA
  modified_base 1: mod_base = OTHER; note = cytidine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
ctgcaggaccggcccgcaatt

SEQ ID NO: 1430 - DNA, 21 bp, synthetic construct
  source 1..21: mol_type = other DNA
  modified_base 1: mod_base = OTHER; note = guanosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
ggcccgcacccgaggatcttt

SEQ ID NO: 1431 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
cgaggatctgacggtggtatt

SEQ ID NO: 1432 - DNA, 21 bp, synthetic construct
  source 1..21: mol_type = other DNA
  modified_base 1: mod_base = OTHER; note = guanosine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
gtggtgctcggccaggaaatt

SEQ ID NO: 1433 - DNA, 21 bp, synthetic construct
  source 1..21: mol_type = other DNA
  modified_base 1: mod_base = OTHER; note = guanosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = uridine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
gccaggaacgccgtaaccatt

SEQ ID NO: 1434 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
cgtaaccacagctgtgagatt

SEQ ID NO: 1435 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
tgtgagccgtgccagacgttt

SEQ ID NO: 1436 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = uridine-3'-phosphate
  modified_base 11: mod_base = OTHER; note = uridine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = guanosine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
tgccagacgttggccgtgatt

SEQ ID NO: 1437 - DNA, 21 bp, synthetic construct
  source 1..21: mol_type = other DNA
  modified_base 1: mod_base = OTHER; note = guanosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
gccgtgcgctcctaccgcttt

SEQ ID NO: 1438 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
taccgcttgcacgaggccttt

SEQ ID NO: 1439 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
acgaggccttctcgcccgttt

SEQ ID NO: 1440 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
tcgcccgtcagctaccagatt

SEQ ID NO: 1441 - DNA, 21 bp, synthetic construct
  source 1..21: mol_type = other DNA
  modified_base 1: mod_base = OTHER; note = cytidine-3'-phosphate
  modified_base 2: mod_base = OTHER; note = uridine-3'-phosphate
  modified_base 3: mod_base = OTHER; note = adenosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = adenosine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
ctaccagcacgacctggcttt

SEQ ID NO: 1442 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
acctggctctgttgcgccttt

SEQ ID NO: 1443 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
ttgcgccttcaggaggatatt

SEQ ID NO: 1444 - DNA, 21 bp, synthetic construct
  source 1..21: mol_type = other DNA
  modified_base 1: mod_base = OTHER; note = guanosine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
gaggatgcggacggcagcttt

SEQ ID NO: 1445 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
acggcagctgcgcgctccttt

SEQ ID NO: 1446 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = uridine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
cgctcctgtcgccttacgttt

SEQ ID NO: 1447 - DNA, 21 bp, synthetic construct
  source 1..21: mol_type = other DNA
  modified_base 1: mod_base = OTHER; note = cytidine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
ccttacgttcagccggtgttt

SEQ ID NO: 1448 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
agccggtgtgcctgccaaatt

SEQ ID NO: 1449 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tgccaagcggcgccgcgcatt

SEQ ID NO: 1450 - DNA, 21 bp, synthetic construct
  source 1..21: mol_type = other DNA
  modified_base 1: mod_base = OTHER; note = guanosine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
gcgccgcgcgaccctccgatt

SEQ ID NO: 1451 - DNA, 21 bp, synthetic construct
  source 1..21: mol_type = other DNA
  modified_base 1: mod_base = OTHER; note = cytidine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
ccctccgagaccacgctcttt

SEQ ID NO: 1452 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
cgctctgccaggtggccgatt

SEQ ID NO: 1453 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
aggtggccggctggggccatt

SEQ ID NO: 1454 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
tggggccaccagttcgagatt

SEQ ID NO: 1455 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = uridine-3'-phosphate
  misc_feature 1..19: note = RNA
  misc_feature 20..21: note = DNA
ttcgagggggcggaggaattt

SEQ ID NO: 1456 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = uridine-3'-phosphate
  modified_base 10: mod_base = OTHER; note = adenosine-3'-phosphate
  modified_base 11: mod_base = OTHER; note = uridine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
cggaggaatatgccagctttt

SEQ ID NO: 1457 - DNA, 21 bp, synthetic construct
  source 1..21: mol_type = other DNA
  modified_base 1: mod_base = OTHER; note = cytidine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
cagcttcctgcaggaggcatt

SEQ ID NO: 1458 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
aggaggcgcaggtaccgtttt

SEQ ID NO: 1459 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
aggtaccgttcctctcccttt

SEQ ID NO: 1460 - DNA, 21 bp, synthetic construct
  source 1..21: mol_type = other DNA
  modified_base 1: mod_base = OTHER; note = cytidine-3'-phosphate
  modified_base 2: mod_base = OTHER; note = uridine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
ctctccctggagcgctgcttt

SEQ ID NO: 1461 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
cgctgctcagccccggacatt

SEQ ID NO: 1462 - DNA, 21 bp, synthetic construct
  source 1..21: mol_type = other DNA
  modified_base 1: mod_base = OTHER; note = cytidine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = uridine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
ccggacgtgcacggatccttt

SEQ ID NO: 1463 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
cggatcctccatcctcccatt

SEQ ID NO: 1464 - DNA, 21 bp, synthetic construct
  source 1..21: mol_type = other DNA
  modified_base 1: mod_base = OTHER; note = cytidine-3'-phosphate
  modified_base 2: mod_base = OTHER; note = adenosine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
catcctccccggcatgctatt

SEQ ID NO: 1465 - DNA, 21 bp, synthetic construct
  source 1..21: mol_type = other DNA
  modified_base 1: mod_base = OTHER; note = cytidine-3'-phosphate
  modified_base 2: mod_base = OTHER; note = adenosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = uridine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
catgctctgcgcagggttatt

SEQ ID NO: 1466 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
agggttcctcgagggcggatt

SEQ ID NO: 1467 - DNA, 21 bp, synthetic construct
  source 1..21: mol_type = other DNA
  modified_base 1: mod_base = OTHER; note = guanosine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
gagggcggcaccgatgcgttt

SEQ ID NO: 1468 - DNA, 21 bp, synthetic construct
  source 1..21: mol_type = other DNA
  modified_base 1: mod_base = OTHER; note = guanosine-3'-phosphate
  modified_base 2: mod_base = OTHER; note = adenosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
gatgcgtgccagggtgatttt

SEQ ID NO: 1469 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
agggtgattccggaggccatt

SEQ ID NO: 1470 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
cggaggcccgctggtgtgttt

SEQ ID NO: 1471 - DNA, 21 bp, synthetic construct
  source 1..21: mol_type = other DNA
  modified_base 1: mod_base = OTHER; note = guanosine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
ggtgtgtgaggaccaagcttt

SEQ ID NO: 1472 - DNA, 21 bp, synthetic construct
  source 1..21: mol_type = other DNA
  modified_base 1: mod_base = OTHER; note = cytidine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
ccaagctgcagagcgccgatt

SEQ ID NO: 1473 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
agagcgccggctcaccctatt

SEQ ID NO: 1474 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = uridine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = uridine-3'-phosphate
  misc_feature 1..19: note = RNA
  misc_feature 20..21: note = DNA
tcaccctgcaaggcatcattt

SEQ ID NO: 1475 - DNA, 21 bp, synthetic construct
  source 1..21: mol_type = other DNA
  modified_base 1: mod_base = OTHER; note = guanosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = adenosine-3'-phosphate
  modified_base 19: mod_base = OTHER; note = uridine-3'-phosphate
  misc_feature 1..19: note = RNA
  misc_feature 20..21: note = DNA
ggcatcatcagctggggattt

SEQ ID NO: 1476 - DNA, 21 bp, synthetic construct
  source 1..21: mol_type = other DNA
  modified_base 1: mod_base = OTHER; note = cytidine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
ctggggatcgggctgtggttt

SEQ ID NO: 1477 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
tgtggtgaccgcaacaagatt

SEQ ID NO: 1478 - DNA, 21 bp, synthetic construct
  source 1..21: mol_type = other DNA
  modified_base 1: mod_base = OTHER; note = cytidine-3'-phosphate
  modified_base 2: mod_base = OTHER; note = adenosine-3'-phosphate
  modified_base 3: mod_base = OTHER; note = adenosine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
caacaagccaggcgtctaatt

SEQ ID NO: 1479 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = adenosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
aggcgtctacaccgatgtatt

SEQ ID NO: 1480 - DNA, 21 bp, synthetic construct
  source 1..21: mol_type = other DNA
  modified_base 1: mod_base = OTHER; note = guanosine-3'-phosphate
  modified_base 2: mod_base = OTHER; note = adenosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
gatgtggcctactacctgatt

SEQ ID NO: 1481 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tactacctggcctggatcatt

SEQ ID NO: 1482 - DNA, 21 bp, synthetic construct
  source 1..21: mol_type = other DNA
  modified_base 1: mod_base = OTHER; note = cytidine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
ctggatccgggagcacacatt

SEQ ID NO: 1483 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = uridine-3'-phosphate
  modified_base 11: mod_base = OTHER; note = uridine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
agcacaccgtttcctgatttt

SEQ ID NO: 1484 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tcctgattgctcagggacttt

SEQ ID NO: 1485 - DNA, 21 bp, synthetic construct
  source 1..21: mol_type = other DNA
  modified_base 1: mod_base = OTHER; note = cytidine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = uridine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
cagggactcatctttcccttt

SEQ ID NO: 1486 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = uridine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = uridine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
tttccctccttggtgattatt

SEQ ID NO: 1487 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
tggtgattccgcagtgagatt

SEQ ID NO: 1488 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = uridine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
agtgagagagtggctgggatt

SEQ ID NO: 1489 - DNA, 21 bp, synthetic construct
  source 1..21: mol_type = other DNA
  modified_base 1: mod_base = OTHER; note = guanosine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = adenosine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
gctggggcatggaaggcaatt

SEQ ID NO: 1490 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
tggaaggcaagattgtgtatt

SEQ ID NO: 1491 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = uridine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
ttgtgtcccattcccccaatt

SEQ ID NO: 1492 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tcccccagtgcggccagcttt

SEQ ID NO: 1493 - DNA, 21 bp, synthetic construct
  source 1..21: mol_type = other DNA
  modified_base 1: mod_base = OTHER; note = guanosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = adenosine-3'-phosphate
  modified_base 19: mod_base = OTHER; note = uridine-3'-phosphate
  misc_feature 1..19: note = RNA
  misc_feature 20..21: note = DNA
gccagctccgcgccaggattt

SEQ ID NO: 1494 - DNA, 21 bp, synthetic construct
  source 1..21: mol_type = other DNA
  modified_base 1: mod_base = OTHER; note = guanosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
gccaggatggcgcaggaaatt

SEQ ID NO: 1495 - DNA, 21 bp, synthetic construct
  source 1..21: mol_type = other DNA
  modified_base 1: mod_base = OTHER; note = guanosine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = uridine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
gcaggaactcaataaagtatt

SEQ ID NO: 1496 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = uridine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = uridine-3'-phosphate
  misc_feature 1..19: note = RNA
  misc_feature 20..21: note = DNA
aataaagtgctttgaaaattt

SEQ ID NO: 1497 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
ttgaaaatgctgagaaaaatt

SEQ ID NO: 1498 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = adenosine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = cytidine-3'-phosphate
  misc_feature 1..19: note = RNA
  misc_feature 20..21: note = DNA
agctgcctatccaggagtctt

SEQ ID NO: 1499 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
tcgttggtccagctgcctatt

SEQ ID NO: 1500 - DNA, 21 bp, synthetic construct
  source 1..21: mol_type = other DNA
  modified_base 1: mod_base = OTHER; note = adenosine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = uridine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
atggcatccgtccgttggttt

SEQ ID NO: 1501 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = uridine-3'-phosphate
  misc_feature 1..19: note = RNA
  misc_feature 20..21: note = DNA
agcagagccctcatggcattt

SEQ ID NO: 1502 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = cytidine-3'-phosphate
  misc_feature 1..19: note = RNA
  misc_feature 20..21: note = DNA
accccaggagcagcagagctt

SEQ ID NO: 1503 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
accagcaggaaccccaggatt

SEQ ID NO: 1504 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = guanosine-3'-phosphate
  misc_feature 1..19: note = RNA
  misc_feature 20..21: note = DNA
actccaagctcaccagcagtt

SEQ ID NO: 1505 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = guanosine-3'-phosphate
  misc_feature 1..19: note = RNA
  misc_feature 20..21: note = DNA
tgaaagtgttgactccaagtt

SEQ ID NO: 1506 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
tcaaggtggaatcgaaagttt

SEQ ID NO: 1507 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = guanosine-3'-phosphate
  misc_feature 1..19: note = RNA
  misc_feature 20..21: note = DNA
tgggggcttcccaaggtggtt

SEQ ID NO: 1508 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = adenosine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = cytidine-3'-phosphate
  misc_feature 1..19: note = RNA
  misc_feature 20..21: note = DNA
acttatgctccttgggggctt

SEQ ID NO: 1509 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = uridine-3'-phosphate
  modified_base 17: mod_base = OTHER; note = adenosine-3'-phosphate
  modified_base 18: mod_base = OTHER; note = uridine-3'-phosphate
  modified_base 19: mod_base = OTHER; note = guanosine-3'-phosphate
  misc_feature 1..19: note = RNA
  misc_feature 20..21: note = DNA
tttcagctttgtacttatgtt

SEQ ID NO: 1510 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
actgtgtgctcttcagctttt

SEQ ID NO: 1511 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
acagtgagaacgactgtgttt

SEQ ID NO: 1512 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
tccccggtgacagtgagaatt

SEQ ID NO: 1513 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
agtggcagggctccccggttt

SEQ ID NO: 1514 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
actggaaggggaagtggcatt

SEQ ID NO: 1515 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
tctgccggtggtactggaatt

SEQ ID NO: 1516 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
ttgtggtacagctgccggttt

SEQ ID NO: 1517 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = uridine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
tgtgggtacatttgtggtatt

SEQ ID NO: 1518 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
tggccggcccttgtgggtatt

SEQ ID NO: 1519 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = cytidine-3'-phosphate
  misc_feature 1..19: note = RNA
  misc_feature 20..21: note = DNA
tgctgagggcctggccggctt

SEQ ID NO: 1520 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = adenosine-3'-phosphate
  modified_base 19: mod_base = OTHER; note = guanosine-3'-phosphate
  misc_feature 1..19: note = RNA
  misc_feature 20..21: note = DNA
ttagcacaccagggctgagtt

SEQ ID NO: 1521 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
agttgggggtggtagcacatt

SEQ ID NO: 1522 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
tctgatcaaagttgggggttt

SEQ ID NO: 1523 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = adenosine-3'-phosphate
  modified_base 19: mod_base = OTHER; note = uridine-3'-phosphate
  misc_feature 1..19: note = RNA
  misc_feature 20..21: note = DNA
tcccatcgctggtcctgattt

SEQ ID NO: 1524 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = adenosine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = adenosine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
aaacagtatccccatcgcttt

SEQ ID NO: 1525 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
tcttgggctccaaacagtatt

SEQ ID NO: 1526 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = guanosine-3'-phosphate
  misc_feature 1..19: note = RNA
  misc_feature 20..21: note = DNA
tggtctttcactttcttggtt

SEQ ID NO: 1527 - DNA, 21 bp, synthetic construct
  source 1..21: mol_type = other DNA
  modified_base 1: mod_base = OTHER; note = guanosine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
gtttgctgcagtggtcttttt

SEQ ID NO: 1528 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = uridine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
aggggctgtgtttgctgcatt

SEQ ID NO: 1529 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
ttcctttctggcaggggcttt

SEQ ID NO: 1530 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = uridine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
acacaggtccctcctttcttt

SEQ ID NO: 1531 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
ttggcatgttcacacaggttt

SEQ ID NO: 1532 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = uridine-3'-phosphate
  misc_feature 1..19: note = RNA
  misc_feature 20..21: note = DNA
agtgggggccgcttggcattt

SEQ ID NO: 1533 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = adenosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = cytidine-3'-phosphate
  misc_feature 1..19: note = RNA
  misc_feature 20..21: note = DNA
tgacagagacagtgggggctt

SEQ ID NO: 1534 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = guanosine-3'-phosphate
  misc_feature 1..19: note = RNA
  misc_feature 20..21: note = DNA
agtggtttccagtgaggtgtt

SEQ ID NO: 1535 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
tctctttctggcagtggtttt

SEQ ID NO: 1536 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = adenosine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = uridine-3'-phosphate
  modified_base 16: mod_base = OTHER; note = uridine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = guanosine-3'-phosphate
  misc_feature 1..19: note = RNA
  misc_feature 20..21: note = DNA
taaagcacttctctttctgtt

SEQ ID NO: 1537 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
taagctgaggctcaaagcatt

SEQ ID NO: 1538 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = guanosine-3'-phosphate
  misc_feature 1..19: note = RNA
  misc_feature 20..21: note = DNA
tgaaaaaccggagaagctgtt

SEQ ID NO: 1539 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
tattcttgtggaaaaaccgtt

SEQ ID NO: 1540 - DNA, 21 bp, synthetic construct
  source 1..21: mol_type = other DNA
  modified_base 1: mod_base = OTHER; note = adenosine-3'-phosphate
  modified_base 2: mod_base = OTHER; note = uridine-3'-phosphate
  modified_base 3: mod_base = OTHER; note = adenosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = uridine-3'-phosphate
  modified_base 8: mod_base = OTHER; note = adenosine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = uridine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = uridine-3'-phosphate
  modified_base 19: mod_base = OTHER; note = guanosine-3'-phosphate
  misc_feature 1..19: note = RNA
  misc_feature 20..21: note = DNA
ataccatatctcattcttgtt

SEQ ID NO: 1541 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = adenosine-3'-phosphate
  modified_base 13: mod_base = OTHER; note = uridine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
tgctcagttctataccatatt

SEQ ID NO: 1542 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tgccacagctgcttgctcatt

SEQ ID NO: 1543 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = cytidine-3'-phosphate
  misc_feature 1..19: note = RNA
  misc_feature 20..21: note = DNA
actggcatctggccacagctt

SEQ ID NO: 1544 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = uridine-3'-phosphate
  misc_feature 1..19: note = RNA
  misc_feature 20..21: note = DNA
aggacccttgcactggcattt

SEQ ID NO: 1545 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
agtgggcatcaggaccctttt

SEQ ID NO: 1546 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tagccgctggcagtgggcatt

SEQ ID NO: 1547 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
aggcctggctggccagccgtt

SEQ ID NO: 1548 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tggtgcggcaggcctggcttt

SEQ ID NO: 1549 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
tgaggcacgggttggtgcgtt

SEQ ID NO: 1550 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
agcgacccccatggaggcatt

SEQ ID NO: 1551 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = cytidine-3'-phosphate
  misc_feature 1..19: note = RNA
  misc_feature 20..21: note = DNA
acctctaggcagcgacccctt

SEQ ID NO: 1552 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = adenosine-3'-phosphate
  modified_base 19: mod_base = OTHER; note = guanosine-3'-phosphate
  misc_feature 1..19: note = RNA
  misc_feature 20..21: note = DNA
tgtggccctccacctctagtt

SEQ ID NO: 1553 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tggcacaggcggtggcccttt

SEQ ID NO: 1554 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tccaccgggcagtggcacatt

SEQ ID NO: 1555 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = uridine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
tctccggtgtagcccaccgtt

SEQ ID NO: 1556 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
tgtcgcagaaggctccggttt

SEQ ID NO: 1557 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = adenosine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
tggtgtccacgtcgcagaatt

SEQ ID NO: 1558 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = cytidine-3'-phosphate
  misc_feature 1..19: note = RNA
  misc_feature 20..21: note = DNA
agcagcttgccttggtgtctt

SEQ ID NO: 1559 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = adenosine-3'-phosphate
  modified_base 10: mod_base = OTHER; note = uridine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = uridine-3'-phosphate
  modified_base 19: mod_base = OTHER; note = guanosine-3'-phosphate
  misc_feature 1..19: note = RNA
  misc_feature 20..21: note = DNA
tggccatcatagcagcttgtt

SEQ ID NO: 1560 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = uridine-3'-phosphate
  modified_base 19: mod_base = OTHER; note = cytidine-3'-phosphate
  misc_feature 1..19: note = RNA
  misc_feature 20..21: note = DNA
agctgagcccgcggccatctt

SEQ ID NO: 1561 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
tccaggccgcggtagctgatt

SEQ ID NO: 1562 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
tgtggtcctggccaggccgtt

SEQ ID NO: 1563 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = uridine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tacccgagagcgtggtccttt

SEQ ID NO: 1564 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
tctgacagggcgcacccgatt

SEQ ID NO: 1565 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = adenosine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = guanosine-3'-phosphate
  misc_feature 1..19: note = RNA
  misc_feature 20..21: note = DNA
tgaggcccacggctgacagtt

SEQ ID NO: 1566 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
aggtggcctccgaggcccatt

SEQ ID NO: 1567 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = guanosine-3'-phosphate
  misc_feature 1..19: note = RNA
  misc_feature 20..21: note = DNA
ttcacgttccggtaggtggtt

SEQ ID NO: 1568 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
tttgctcggcagtcacgtttt

SEQ ID NO: 1569 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
tcagttccgcgcttgctcgtt

SEQ ID NO: 1570 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = uridine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
tgcccagtccccagttccgtt

SEQ ID NO: 1571 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = cytidine-3'-phosphate
  misc_feature 1..19: note = RNA
  misc_feature 20..21: note = DNA
aaggcgtggccgcccagtctt

SEQ ID NO: 1572 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
tggttccggcagaaggcgttt

SEQ ID NO: 1573 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = uridine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
tgtcgttgtccgggttccgtt

SEQ ID NO: 1574 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
accacgggcggatgtcgtttt

SEQ ID NO: 1575 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = cytidine-3'-phosphate
  misc_feature 1..19: note = RNA
  misc_feature 20..21: note = DNA
agcacgaagcaccacgggctt

SEQ ID NO: 1576 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
tgtcgcggttcagcacgaatt

SEQ ID NO: 1577 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
tagctcagccggtcgcggttt

SEQ ID NO: 1578 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = guanosine-3'-phosphate
  misc_feature 1..19: note = RNA
  misc_feature 20..21: note = DNA
tgcagtactcccagctcagtt

SEQ ID NO: 1579 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
actgtgccaggtcgcagtatt

SEQ ID NO: 1580 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tgggtctggcactgtgccatt

SEQ ID NO: 1581 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = uridine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tccgcctgggttggggtcttt

SEQ ID NO: 1582 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tgggtcggaggcgccgccttt

SEQ ID NO: 1583 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
aggggacaccggggtcggatt

SEQ ID NO: 1584 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
acatgaagcctaggggacatt

SEQ ID NO: 1585 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
tgcatgagtgggacatgaatt

SEQ ID NO: 1586 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
tggctgcgcgggcatgagttt

SEQ ID NO: 1587 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
ttcggcggtgccggctgcgtt

SEQ ID NO: 1588 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
tggctgaggcttcggcggttt

SEQ ID NO: 1589 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
tgtccgggtcgtgggctgatt

SEQ ID NO: 1590 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
actgaggcggggtccgggttt

SEQ ID NO: 1591 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = guanosine-3'-phosphate
  misc_feature 1..19: note = RNA
  misc_feature 20..21: note = DNA
tcggggtctgggactgaggtt

SEQ ID NO: 1592 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tgcaaggctcccggggtcttt

SEQ ID NO: 1593 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = guanosine-3'-phosphate
  misc_feature 1..19: note = RNA
  misc_feature 20..21: note = DNA
tcccgcttcgccggcaaggtt

SEQ ID NO: 1594 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
aaggcggctgctcccgctttt

SEQ ID NO: 1595 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
ttggtcagggaaggcggcttt

SEQ ID NO: 1596 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = uridine-3'-phosphate
  modified_base 11: mod_base = OTHER; note = uridine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
agtgggccgttcctggtcatt

SEQ ID NO: 1597 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
tccgcagctcagtgggccgtt

SEQ ID NO: 1598 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tgcggagccgctgcccgcatt

SEQ ID NO: 1599 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
acagactcttgcggagccgtt

SEQ ID NO: 1600 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tggtcatcgaagacagacttt

SEQ ID NO: 1601 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = adenosine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
tcaacgacgcgggtcatcgtt

SEQ ID NO: 1602 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
tccaccagcccgccaacgatt

SEQ ID NO: 1603 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tccccgcgtagcgccaccatt

SEQ ID NO: 1604 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
taggggtgcgccccgcgtatt

SEQ ID NO: 1605 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = uridine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
agcgcggcgatgtaggggttt

SEQ ID NO: 1606 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = adenosine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = cytidine-3'-phosphate
  misc_feature 1..19: note = RNA
  misc_feature 20..21: note = DNA
tgccccagtacagcgcggctt

SEQ ID NO: 1607 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = uridine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = guanosine-3'-phosphate
  misc_feature 1..19: note = RNA
  misc_feature 20..21: note = DNA
tcagaaactgtggccccagtt

SEQ ID NO: 1608 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
taggctgccggcgcagaaatt

SEQ ID NO: 1609 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
tggggcgatgaggctgccgtt

SEQ ID NO: 1610 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
agcacccagcagggggcgatt

SEQ ID NO: 1611 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tagcggccgtcagcacccatt

SEQ ID NO: 1612 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = cytidine-3'-phosphate
  misc_feature 1..19: note = RNA
  misc_feature 20..21: note = DNA
tctgcaggcagtgagcggctt

SEQ ID NO: 1613 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = guanosine-3'-phosphate
  misc_feature 1..19: note = RNA
  misc_feature 20..21: note = DNA
ttgcgggccggtcctgcagtt

SEQ ID NO: 1614 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = cytidine-3'-phosphate
  misc_feature 1..19: note = RNA
  misc_feature 20..21: note = DNA
agatcctcgggtgcgggcctt

SEQ ID NO: 1615 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
taccaccgtcagatcctcgtt

SEQ ID NO: 1616 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = cytidine-3'-phosphate
  misc_feature 1..19: note = RNA
  misc_feature 20..21: note = DNA
tttcctggccgagcaccactt

SEQ ID NO: 1617 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = adenosine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = cytidine-3'-phosphate
  misc_feature 1..19: note = RNA
  misc_feature 20..21: note = DNA
tggttacggcgttcctggctt

SEQ ID NO: 1618 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = uridine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
tctcacagctgtggttacgtt

SEQ ID NO: 1619 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
acgtctggcacggctcacatt

SEQ ID NO: 1620 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = cytidine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tcacggccaacgtctggcatt

SEQ ID NO: 1621 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = cytidine-3'-phosphate
  misc_feature 1..19: note = RNA
  misc_feature 20..21: note = DNA
agcggtaggagcgcacggctt

SEQ ID NO: 1622 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
aggcctcgtgcaagcggtatt

SEQ ID NO: 1623 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = cytidine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
acgggcgagaaggcctcgttt

SEQ ID NO: 1624 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
tctggtagctgacgggcgatt

SEQ ID NO: 1625 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = uridine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = uridine-3'-phosphate
  modified_base 18: mod_base = OTHER; note = adenosine-3'-phosphate
  modified_base 19: mod_base = OTHER; note = guanosine-3'-phosphate
  misc_feature 1..19: note = RNA
  misc_feature 20..21: note = DNA
agccaggtcgtgctggtagtt

SEQ ID NO: 1626 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
aggcgcaacagagccaggttt

SEQ ID NO: 1627 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
tatcctcctgaaggcgcaatt

SEQ ID NO: 1628 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = cytidine-3'-phosphate
  misc_feature 1..19: note = RNA
  misc_feature 20..21: note = DNA
agctgccgtccgcatcctctt

SEQ ID NO: 1629 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
aggagcgcgcagctgccgttt

SEQ ID NO: 1630 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = adenosine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
acgtaaggcgacaggagcgtt

SEQ ID NO: 1631 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = guanosine-3'-phosphate
  misc_feature 1..19: note = RNA
  misc_feature 20..21: note = DNA
acaccggctgaacgtaaggtt

SEQ ID NO: 1632 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tttggcaggcacaccggcttt

SEQ ID NO: 1633 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tgcgcggcgccgcttggcatt

SEQ ID NO: 1634 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = guanosine-3'-phosphate
  modified_base 19: mod_base = OTHER; note = cytidine-3'-phosphate
  misc_feature 1..19: note = RNA
  misc_feature 20..21: note = DNA
tcggagggtcgcgcggcgctt

SEQ ID NO: 1635 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = guanosine-3'-phosphate
  misc_feature 1..19: note = RNA
  misc_feature 20..21: note = DNA
agagcgtggtctcggagggtt

SEQ ID NO: 1636 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
tcggccacctggcagagcgtt

SEQ ID NO: 1637 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tggccccagccggccaccttt

SEQ ID NO: 1638 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tctcgaactggtggccccatt

SEQ ID NO: 1639 - DNA, 21 bp, synthetic construct
  source 1..21: mol_type = other DNA
  modified_base 1: mod_base = OTHER; note = adenosine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
attcctccgccccctcgaatt

SEQ ID NO: 1640 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = adenosine-3'-phosphate
  modified_base 10: mod_base = OTHER; note = uridine-3'-phosphate
  modified_base 11: mod_base = OTHER; note = adenosine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
aagctggcatattcctccgtt

SEQ ID NO: 1641 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = guanosine-3'-phosphate
  misc_feature 1..19: note = RNA
  misc_feature 20..21: note = DNA
tgcctcctgcaggaagctgtt

SEQ ID NO: 1642 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
aacggtacctgcgcctccttt

SEQ ID NO: 1643 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
agggagaggaacggtaccttt

SEQ ID NO: 1644 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = adenosine-3'-phosphate
  modified_base 19: mod_base = OTHER; note = guanosine-3'-phosphate
  misc_feature 1..19: note = RNA
  misc_feature 20..21: note = DNA
agcagcgctccagggagagtt

SEQ ID NO: 1645 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
tgtccggggctgagcagcgtt

SEQ ID NO: 1646 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = guanosine-3'-phosphate
  modified_base 19: mod_base = OTHER; note = guanosine-3'-phosphate
  misc_feature 1..19: note = RNA
  misc_feature 20..21: note = DNA
aggatccgtgcacgtccggtt

SEQ ID NO: 1647 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = uridine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
tgggaggatggaggatccgtt

SEQ ID NO: 1648 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = uridine-3'-phosphate
  modified_base 19: mod_base = OTHER; note = guanosine-3'-phosphate
  misc_feature 1..19: note = RNA
  misc_feature 20..21: note = DNA
tagcatgccggggaggatgtt

SEQ ID NO: 1649 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = adenosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = uridine-3'-phosphate
  modified_base 19: mod_base = OTHER; note = guanosine-3'-phosphate
  misc_feature 1..19: note = RNA
  misc_feature 20..21: note = DNA
taaccctgcgcagagcatgtt

SEQ ID NO: 1650 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tccgccctcgaggaacccttt

SEQ ID NO: 1651 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = cytidine-3'-phosphate
  misc_feature 1..19: note = RNA
  misc_feature 20..21: note = DNA
acgcatcggtgccgccctctt

SEQ ID NO: 1652 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = uridine-3'-phosphate
  modified_base 19: mod_base = OTHER; note = cytidine-3'-phosphate
  misc_feature 1..19: note = RNA
  misc_feature 20..21: note = DNA
aatcaccctggcacgcatctt

SEQ ID NO: 1653 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tggcctccggaatcacccttt

SEQ ID NO: 1654 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
acacaccagcgggcctccgtt

SEQ ID NO: 1655 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = cytidine-3'-phosphate
  misc_feature 1..19: note = RNA
  misc_feature 20..21: note = DNA
agcttggtcctcacacacctt

SEQ ID NO: 1656 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = guanosine-3'-phosphate
  misc_feature 1..19: note = RNA
  misc_feature 20..21: note = DNA
tcggcgctctgcagcttggtt

SEQ ID NO: 1657 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tagggtgagccggcgctcttt

SEQ ID NO: 1658 - DNA, 21 bp, synthetic construct
  source 1..21: mol_type = other DNA
  modified_base 1: mod_base = OTHER; note = adenosine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
atgatgccttgcagggtgatt

SEQ ID NO: 1659 - DNA, 21 bp, synthetic construct
  source 1..21: mol_type = other DNA
  modified_base 1: mod_base = OTHER; note = adenosine-3'-phosphate
  modified_base 2: mod_base = OTHER; note = uridine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = cytidine-3'-phosphate
  misc_feature 1..19: note = RNA
  misc_feature 20..21: note = DNA
atccccagctgatgatgcctt

SEQ ID NO: 1660 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = guanosine-3'-phosphate
  misc_feature 1..19: note = RNA
  misc_feature 20..21: note = DNA
accacagcccgatccccagtt

SEQ ID NO: 1661 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tcttgttgcggtcaccacatt

SEQ ID NO: 1662 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = uridine-3'-phosphate
  modified_base 18: mod_base = OTHER; note = uridine-3'-phosphate
  modified_base 19: mod_base = OTHER; note = guanosine-3'-phosphate
  misc_feature 1..19: note = RNA
  misc_feature 20..21: note = DNA
ttagacgcctggcttgttgtt

SEQ ID NO: 1663 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = uridine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tacatcggtgtagacgccttt

SEQ ID NO: 1664 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = uridine-3'-phosphate
  modified_base 19: mod_base = OTHER; note = cytidine-3'-phosphate
  misc_feature 1..19: note = RNA
  misc_feature 20..21: note = DNA
tcaggtagtaggccacatctt

SEQ ID NO: 1665 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
tgatccaggccaggtagtatt

SEQ ID NO: 1666 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = guanosine-3'-phosphate
  misc_feature 1..19: note = RNA
  misc_feature 20..21: note = DNA
tgtgtgctcccggatccagtt

SEQ ID NO: 1667 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
aatcaggaaacggtgtgcttt

SEQ ID NO: 1668 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
agtccctgagcaatcaggatt

SEQ ID NO: 1669 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = adenosine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = guanosine-3'-phosphate
  misc_feature 1..19: note = RNA
  misc_feature 20..21: note = DNA
agggaaagatgagtccctgtt

SEQ ID NO: 1670 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = adenosine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
taatcaccaaggagggaaatt

SEQ ID NO: 1671 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tctcactgcggaatcaccatt

SEQ ID NO: 1672 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = adenosine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tcccagccactctctcacttt

SEQ ID NO: 1673 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = uridine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = cytidine-3'-phosphate
  misc_feature 1..19: note = RNA
  misc_feature 20..21: note = DNA
ttgccttccatgccccagctt

SEQ ID NO: 1674 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = uridine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = uridine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tacacaatcttgccttccatt

SEQ ID NO: 1675 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = adenosine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
ttgggggaatgggacacaatt

SEQ ID NO: 1676 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
agctggccgcactgggggatt

SEQ ID NO: 1677 - DNA, 21 bp, synthetic construct
  source 1..21: mol_type = other DNA
  modified_base 1: mod_base = OTHER; note = adenosine-3'-phosphate
  modified_base 2: mod_base = OTHER; note = uridine-3'-phosphate
  modified_base 3: mod_base = OTHER; note = cytidine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = cytidine-3'-phosphate
  misc_feature 1..19: note = RNA
  misc_feature 20..21: note = DNA
atcctggcgcggagctggctt

SEQ ID NO: 1678 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = cytidine-3'-phosphate
  misc_feature 1..19: note = RNA
  misc_feature 20..21: note = DNA
tttcctgcgccatcctggctt

SEQ ID NO: 1679 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = adenosine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = cytidine-3'-phosphate
  misc_feature 1..19: note = RNA
  misc_feature 20..21: note = DNA
tactttattgagttcctgctt

SEQ ID NO: 1680 - DNA, 21 bp, synthetic construct
  source 1..21: mol_type = other DNA
  modified_base 1: mod_base = OTHER; note = adenosine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = uridine-3'-phosphate
  modified_base 16: mod_base = OTHER; note = uridine-3'-phosphate
  modified_base 17: mod_base = OTHER; note = adenosine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
attttcaaagcactttatttt

SEQ ID NO: 1681 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = uridine-3'-phosphate
  modified_base 16: mod_base = OTHER; note = uridine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
tttttctcagcattttcaatt

SEQ ID NO: 1682 - RNA, 19 nt, synthetic construct
  source 1..19: mol_type = other RNA
gactcctggataggcagct

SEQ ID NO: 1683 - RNA, 19 nt, synthetic construct
  source 1..19: mol_type = other RNA
taggcagctggaccaacgg

SEQ ID NO: 1684 - RNA, 19 nt, synthetic construct
  source 1..19: mol_type = other RNA
accaacggacggatgccat

SEQ ID NO: 1685 - RNA, 19 nt, synthetic construct
  source 1..19: mol_type = other RNA
atgccatgagggctctgct

SEQ ID NO: 1686 - RNA, 19 nt, synthetic construct
  source 1..19: mol_type = other RNA
gctctgctgctcctggggt

SEQ ID NO: 1687 - RNA, 19 nt, synthetic construct
  source 1..19: mol_type = other RNA
tcctggggttcctgctggt

SEQ ID NO: 1688 - RNA, 19 nt, synthetic construct
  source 1..19: mol_type = other RNA
ctgctggtgagcttggagt

SEQ ID NO: 1689 - RNA, 19 nt, synthetic construct
  source 1..19: mol_type = other RNA
cttggagtcaacactttcg

SEQ ID NO: 1690 - RNA, 19 nt, synthetic construct
  source 1..19: mol_type = other RNA
actttcgattccaccttgg

SEQ ID NO: 1691 - RNA, 19 nt, synthetic construct
  source 1..19: mol_type = other RNA
ccaccttgggaagccccca

SEQ ID NO: 1692 - RNA, 19 nt, synthetic construct
  source 1..19: mol_type = other RNA
gcccccaaggagcataagt

SEQ ID NO: 1693 - RNA, 19 nt, synthetic construct
  source 1..19: mol_type = other RNA
cataagtacaaagctgaag

SEQ ID NO: 1694 - RNA, 19 nt, synthetic construct
  source 1..19: mol_type = other RNA
aagctgaagagcacacagt

SEQ ID NO: 1695 - RNA, 19 nt, synthetic construct
  source 1..19: mol_type = other RNA
acacagtcgttctcactgt

SEQ ID NO: 1696 - RNA, 19 nt, synthetic construct
  source 1..19: mol_type = other RNA
ttctcactgtcaccgggga

SEQ ID NO: 1697 - RNA, 19 nt, synthetic construct
  source 1..19: mol_type = other RNA
accggggagccctgccact

SEQ ID NO: 1698 - RNA, 19 nt, synthetic construct
  source 1..19: mol_type = other RNA
tgccacttccccttccagt

SEQ ID NO: 1699 - RNA, 19 nt, synthetic construct
  source 1..19: mol_type = other RNA
ttccagtaccaccggcagc

SEQ ID NO: 1700 - RNA, 19 nt, synthetic construct
  source 1..19: mol_type = other RNA
accggcagctgtaccacaa

SEQ ID NO: 1701 - RNA, 19 nt, synthetic construct
  source 1..19: mol_type = other RNA
taccacaaatgtacccaca

SEQ ID NO: 1702 - RNA, 19 nt, synthetic construct
  source 1..19: mol_type = other RNA
tacccacaagggccggcca

SEQ ID NO: 1703 - RNA, 19 nt, synthetic construct
  source 1..19: mol_type = other RNA
gccggccaggccctcagcc

SEQ ID NO: 1704 - RNA, 19 nt, synthetic construct
  source 1..19: mol_type = other RNA
ctcagccctggtgtgctac

SEQ ID NO: 1705 - RNA, 19 nt, synthetic construct
  source 1..19: mol_type = other RNA
tgtgctaccacccccaact

SEQ ID NO: 1706 - RNA, 19 nt, synthetic construct
  source 1..19: mol_type = other RNA
acccccaactttgatcagg

SEQ ID NO: 1707 - RNA, 19 nt, synthetic construct
  source 1..19: mol_type = other RNA
atcaggaccagcgatgggg

SEQ ID NO: 1708 - RNA, 19 nt, synthetic construct
  source 1..19: mol_type = other RNA
agcgatggggatactgttt

SEQ ID NO: 1709 - RNA, 19 nt, synthetic construct
  source 1..19: mol_type = other RNA
tactgtttggagcccaaga

SEQ ID NO: 1710 - RNA, 19 nt, synthetic construct
  source 1..19: mol_type = other RNA
ccaagaaagtgaaagacca

SEQ ID NO: 1711 - RNA, 19 nt, synthetic construct
  source 1..19: mol_type = other RNA
aaagaccactgcagcaaac

SEQ ID NO: 1712 - RNA, 19 nt, synthetic construct
  source 1..19: mol_type = other RNA
tgcagcaaacacagcccct

SEQ ID NO: 1713 - RNA, 19 nt, synthetic construct
  source 1..19: mol_type = other RNA
agcccctgccagaaaggag

SEQ ID NO: 1714 - RNA, 19 nt, synthetic construct
  source 1..19: mol_type = other RNA
agaaaggagggacctgtgt

SEQ ID NO: 1715 - RNA, 19 nt, synthetic construct
  source 1..19: mol_type = other RNA
acctgtgtgaacatgccaa

SEQ ID NO: 1716 - RNA, 19 nt, synthetic construct
  source 1..19: mol_type = other RNA
atgccaagcggcccccact

SEQ ID NO: 1717 - RNA, 19 nt, synthetic construct
  source 1..19: mol_type = other RNA
gcccccactgtctctgtcc

SEQ ID NO: 1718 - RNA, 19 nt, synthetic construct
  source 1..19: mol_type = other RNA
cacctcactggaaaccact

SEQ ID NO: 1719 - RNA, 19 nt, synthetic construct
  source 1..19: mol_type = other RNA
aaccactgccagaaagaga

SEQ ID NO: 1720 - RNA, 19 nt, synthetic construct
  source 1..19: mol_type = other RNA
cagaaagagaagtgctttg

SEQ ID NO: 1721 - RNA, 19 nt, synthetic construct
  source 1..19: mol_type = other RNA
tgctttgagcctcagcttc

SEQ ID NO: 1722 - RNA, 19 nt, synthetic construct
  source 1..19: mol_type = other RNA
cagcttctccggtttttcc

SEQ ID NO: 1723 - RNA, 19 nt, synthetic construct
  source 1..19: mol_type = other RNA
cggtttttccacaagaatg

SEQ ID NO: 1724 - RNA, 19 nt, synthetic construct
  source 1..19: mol_type = other RNA
caagaatgagatatggtat

SEQ ID NO: 1725 - RNA, 19 nt, synthetic construct
  source 1..19: mol_type = other RNA
tatggtatagaactgagca

SEQ ID NO: 1726 - RNA, 19 nt, synthetic construct
  source 1..19: mol_type = other RNA
tgagcaagcagctgtggcc

SEQ ID NO: 1727 - RNA, 19 nt, synthetic construct
  source 1..19: mol_type = other RNA
gctgtggccagatgccagt

SEQ ID NO: 1728 - RNA, 19 nt, synthetic construct
  source 1..19: mol_type = other RNA
atgccagtgcaagggtcct

SEQ ID NO: 1729 - RNA, 19 nt, synthetic construct
  source 1..19: mol_type = other RNA
aagggtcctgatgcccact

SEQ ID NO: 1730 - RNA, 19 nt, synthetic construct
  source 1..19: mol_type = other RNA
tgcccactgccagcggctg

SEQ ID NO: 1731 - RNA, 19 nt, synthetic construct
  source 1..19: mol_type = other RNA
cggctggccagccaggcct

SEQ ID NO: 1732 - RNA, 19 nt, synthetic construct
  source 1..19: mol_type = other RNA
agccaggcctgccgcacca

SEQ ID NO: 1733 - RNA, 19 nt, synthetic construct
  source 1..19: mol_type = other RNA
cgcaccaacccgtgcctcc

SEQ ID NO: 1734 - RNA, 19 nt, synthetic construct
  source 1..19: mol_type = other RNA
tgcctccatgggggtcgct

SEQ ID NO: 1735 - RNA, 19 nt, synthetic construct
  source 1..19: mol_type = other RNA
ggggtcgctgcctagaggt

SEQ ID NO: 1736 - RNA, 19 nt, synthetic construct
  source 1..19: mol_type = other RNA
ctagaggtggagggccacc

SEQ ID NO: 1737 - RNA, 19 nt, synthetic construct
  source 1..19: mol_type = other RNA
agggccaccgcctgtgcca

SEQ ID NO: 1738 - RNA, 19 nt, synthetic construct
  source 1..19: mol_type = other RNA
tgtgccactgcccggtggg

SEQ ID NO: 1739 - RNA, 19 nt, synthetic construct
  source 1..19: mol_type = other RNA
cggtgggctacaccggagc

SEQ ID NO: 1740 - RNA, 19 nt, synthetic construct
  source 1..19: mol_type = other RNA
accggagccttctgcgacg

SEQ ID NO: 1741 - RNA, 19 nt, synthetic construct
  source 1..19: mol_type = other RNA
ttctgcgacgtggacacca

SEQ ID NO: 1742 - RNA, 19 nt, synthetic construct
  source 1..19: mol_type = other RNA
gacaccaaggcaagctgct

SEQ ID NO: 1743 - RNA, 19 nt, synthetic construct
  source 1..19: mol_type = other RNA
caagctgctatgatggccg

SEQ ID NO: 1744 - RNA, 19 nt, synthetic construct
  source 1..19: mol_type = other RNA
gatggccgcgggctcagct

SEQ ID NO: 1745 - RNA, 19 nt, synthetic construct
  source 1..19: mol_type = other RNA
tcagctaccgcggcctggc

SEQ ID NO: 1746 - RNA, 19 nt, synthetic construct
  source 1..19: mol_type = other RNA
cggcctggccaggaccacg

SEQ ID NO: 1747 - RNA, 19 nt, synthetic construct
  source 1..19: mol_type = other RNA
aggaccacgctctcgggtg

SEQ ID NO: 1748 - RNA, 19 nt, synthetic construct
  source 1..19: mol_type = other RNA
tcgggtgcgccctgtcagc

SEQ ID NO: 1749 - RNA, 19 nt, synthetic construct
  source 1..19: mol_type = other RNA
ctgtcagccgtgggcctcg

SEQ ID NO: 1750 - RNA, 19 nt, synthetic construct
  source 1..19: mol_type = other RNA
tgggcctcggaggccacct

SEQ ID NO: 1751 - RNA, 19 nt, synthetic construct
  source 1..19: mol_type = other RNA
ccacctaccggaacgtgac

SEQ ID NO: 1752 - RNA, 19 nt, synthetic construct
  source 1..19: mol_type = other RNA
aacgtgactgccgagcaag

SEQ ID NO: 1753 - RNA, 19 nt, synthetic construct
  source 1..19: mol_type = other RNA
cgagcaagcgcggaactgg

SEQ ID NO: 1754 - RNA, 19 nt, synthetic construct
  source 1..19: mol_type = other RNA
cggaactggggactgggcg

SEQ ID NO: 1755 - RNA, 19 nt, synthetic construct
  source 1..19: mol_type = other RNA
gactgggcggccacgcctt

SEQ ID NO: 1756 - RNA, 19 nt, synthetic construct
  source 1..19: mol_type = other RNA
acgccttctgccggaaccc

SEQ ID NO: 1757 - RNA, 19 nt, synthetic construct
  source 1..19: mol_type = other RNA
cggaacccggacaacgaca

SEQ ID NO: 1758 - RNA, 19 nt, synthetic construct
  source 1..19: mol_type = other RNA
aacgacatccgcccgtggt

SEQ ID NO: 1759 - RNA, 19 nt, synthetic construct
  source 1..19: mol_type = other RNA
gcccgtggtgcttcgtgct

SEQ ID NO: 1760 - RNA, 19 nt, synthetic construct
  source 1..19: mol_type = other RNA
ttcgtgctgaaccgcgacc

SEQ ID NO: 1761 - RNA, 19 nt, synthetic construct
  source 1..19: mol_type = other RNA
accgcgaccggctgagctg

SEQ ID NO: 1762 - RNA, 19 nt, synthetic construct
  source 1..19: mol_type = other RNA
ctgagctgggagtactgcg

SEQ ID NO: 1763 - RNA, 19 nt, synthetic construct
  source 1..19: mol_type = other RNA
tactgcgacctggcacagt

SEQ ID NO: 1764 - RNA, 19 nt, synthetic construct
  source 1..19: mol_type = other RNA
tggcacagtgccagacccc

SEQ ID NO: 1765 - RNA, 19 nt, synthetic construct
  source 1..19: mol_type = other RNA
agaccccaacccaggcggc

SEQ ID NO: 1766 - RNA, 19 nt, synthetic construct
  source 1..19: mol_type = other RNA
aggcggcgcctccgacccc

SEQ ID NO: 1767 - RNA, 19 nt, synthetic construct
  source 1..19: mol_type = other RNA
tccgaccccggtgtcccct

SEQ ID NO: 1768 - RNA, 19 nt, synthetic construct
  source 1..19: mol_type = other RNA
tgtcccctaggcttcatgt

SEQ ID NO: 1769 - RNA, 19 nt, synthetic construct
  source 1..19: mol_type = other RNA
ttcatgtcccactcatgcc

SEQ ID NO: 1770 - RNA, 19 nt, synthetic construct
  source 1..19: mol_type = other RNA
actcatgcccgcgcagccg

SEQ ID NO: 1771 - RNA, 19 nt, synthetic construct
  source 1..19: mol_type = other RNA
cgcagccggcaccgccgaa

SEQ ID NO: 1772 - RNA, 19 nt, synthetic construct
  source 1..19: mol_type = other RNA
accgccgaagcctcagccc

SEQ ID NO: 1773 - RNA, 19 nt, synthetic construct
  source 1..19: mol_type = other RNA
tcagcccacgacccggacc

SEQ ID NO: 1774 - RNA, 19 nt, synthetic construct
  source 1..19: mol_type = other RNA
acccggaccccgcctcagt

SEQ ID NO: 1775 - RNA, 19 nt, synthetic construct
  source 1..19: mol_type = other RNA
cctcagtcccagaccccgg

SEQ ID NO: 1776 - RNA, 19 nt, synthetic construct
  source 1..19: mol_type = other RNA
agaccccgggagccttgcc

SEQ ID NO: 1777 - RNA, 19 nt, synthetic construct
  source 1..19: mol_type = other RNA
ccttgccggcgaagcggga

SEQ ID NO: 1778 - RNA, 19 nt, synthetic construct
  source 1..19: mol_type = other RNA
aagcgggagcagccgcctt

SEQ ID NO: 1779 - RNA, 19 nt, synthetic construct
  source 1..19: mol_type = other RNA
agccgccttccctgaccag

SEQ ID NO: 1780 - RNA, 19 nt, synthetic construct
  source 1..19: mol_type = other RNA
tgaccaggaacggcccact

SEQ ID NO: 1781 - RNA, 19 nt, synthetic construct
  source 1..19: mol_type = other RNA
cggcccactgagctgcggg

SEQ ID NO: 1782 - RNA, 19 nt, synthetic construct
  source 1..19: mol_type = other RNA
tgcgggcagcggctccgca

SEQ ID NO: 1783 - RNA, 19 nt, synthetic construct
  source 1..19: mol_type = other RNA
cggctccgcaagagtctgt

SEQ ID NO: 1784 - RNA, 19 nt, synthetic construct
  source 1..19: mol_type = other RNA
agtctgtcttcgatgaccc

SEQ ID NO: 1785 - RNA, 19 nt, synthetic construct
  source 1..19: mol_type = other RNA
cgatgacccgcgtcgttgg

SEQ ID NO: 1786 - RNA, 19 nt, synthetic construct
  source 1..19: mol_type = other RNA
tcgttggcgggctggtggc

SEQ ID NO: 1787 - RNA, 19 nt, synthetic construct
  source 1..19: mol_type = other RNA
tggtggcgctacgcggggc

SEQ ID NO: 1788 - RNA, 19 nt, synthetic construct
  source 1..19: mol_type = other RNA
tacgcggggcgcaccccta

SEQ ID NO: 1789 - RNA, 19 nt, synthetic construct
  source 1..19: mol_type = other RNA
acccctacatcgccgcgct

SEQ ID NO: 1790 - RNA, 19 nt, synthetic construct
  source 1..19: mol_type = other RNA
gccgcgctgtactggggcc

SEQ ID NO: 1791 - RNA, 19 nt, synthetic construct
  source 1..19: mol_type = other RNA
ctggggccacagtttctgc

SEQ ID NO: 1792 - RNA, 19 nt, synthetic construct
  source 1..19: mol_type = other RNA
tttctgcgccggcagcctc

SEQ ID NO: 1793 - RNA, 19 nt, synthetic construct
  source 1..19: mol_type = other RNA
cggcagcctcatcgccccc

SEQ ID NO: 1794 - RNA, 19 nt, synthetic construct
  source 1..19: mol_type = other RNA
tcgccccctgctgggtgct

SEQ ID NO: 1795 - RNA, 19 nt, synthetic construct
  source 1..19: mol_type = other RNA
tgggtgctgacggccgctc

SEQ ID NO: 1796 - RNA, 19 nt, synthetic construct
  source 1..19: mol_type = other RNA
gccgctcactgcctgcagg

SEQ ID NO: 1797 - RNA, 19 nt, synthetic construct
  source 1..19: mol_type = other RNA
ctgcaggaccggcccgcac

SEQ ID NO: 1798 - RNA, 19 nt, synthetic construct
  source 1..19: mol_type = other RNA
ggcccgcacccgaggatct

SEQ ID NO: 1799 - RNA, 19 nt, synthetic construct
  source 1..19: mol_type = other RNA
cgaggatctgacggtggtg

SEQ ID NO: 1800 - RNA, 19 nt, synthetic construct
  source 1..19: mol_type = other RNA
gtggtgctcggccaggaac

SEQ ID NO: 1801 - RNA, 19 nt, synthetic construct
  source 1..19: mol_type = other RNA
gccaggaacgccgtaacca

SEQ ID NO: 1802 - RNA, 19 nt, synthetic construct
  source 1..19: mol_type = other RNA
cgtaaccacagctgtgagc

SEQ ID NO: 1803 - RNA, 19 nt, synthetic construct
  source 1..19: mol_type = other RNA
tgtgagccgtgccagacgt

SEQ ID NO: 1804 - RNA, 19 nt, synthetic construct
  source 1..19: mol_type = other RNA
tgccagacgttggccgtgc

SEQ ID NO: 1805 - RNA, 19 nt, synthetic construct
  source 1..19: mol_type = other RNA
gccgtgcgctcctaccgct

SEQ ID NO: 1806 - RNA, 19 nt, synthetic construct
  source 1..19: mol_type = other RNA
taccgcttgcacgaggcct

SEQ ID NO: 1807 - RNA, 19 nt, synthetic construct
  source 1..19: mol_type = other RNA
acgaggccttctcgcccgt

SEQ ID NO: 1808 - RNA, 19 nt, synthetic construct
  source 1..19: mol_type = other RNA
tcgcccgtcagctaccagc

SEQ ID NO: 1809 - RNA, 19 nt, synthetic construct
  source 1..19: mol_type = other RNA
ctaccagcacgacctggct

SEQ ID NO: 1810 - RNA, 19 nt, synthetic construct
  source 1..19: mol_type = other RNA
acctggctctgttgcgcct

SEQ ID NO: 1811 - RNA, 19 nt, synthetic construct
  source 1..19: mol_type = other RNA
ttgcgccttcaggaggatg

SEQ ID NO: 1812 - RNA, 19 nt, synthetic construct
  source 1..19: mol_type = other RNA
gaggatgcggacggcagct

SEQ ID NO: 1813 - RNA, 19 nt, synthetic construct
  source 1..19: mol_type = other RNA
acggcagctgcgcgctcct

SEQ ID NO: 1814 - RNA, 19 nt, synthetic construct
  source 1..19: mol_type = other RNA
cgctcctgtcgccttacgt

SEQ ID NO: 1815 - RNA, 19 nt, synthetic construct
  source 1..19: mol_type = other RNA
ccttacgttcagccggtgt

SEQ ID NO: 1816 - RNA, 19 nt, synthetic construct
  source 1..19: mol_type = other RNA
agccggtgtgcctgccaag

SEQ ID NO: 1817 - RNA, 19 nt, synthetic construct
  source 1..19: mol_type = other RNA
tgccaagcggcgccgcgcg

SEQ ID NO: 1818 - RNA, 19 nt, synthetic construct
  source 1..19: mol_type = other RNA
gcgccgcgcgaccctccga

SEQ ID NO: 1819 - RNA, 19 nt, synthetic construct
  source 1..19: mol_type = other RNA
ccctccgagaccacgctct

SEQ ID NO: 1820 - RNA, 19 nt, synthetic construct
  source 1..19: mol_type = other RNA
cgctctgccaggtggccgg

SEQ ID NO: 1821 - RNA, 19 nt, synthetic construct
  source 1..19: mol_type = other RNA
aggtggccggctggggcca

SEQ ID NO: 1822 - RNA, 19 nt, synthetic construct
  source 1..19: mol_type = other RNA
tggggccaccagttcgagg

SEQ ID NO: 1823 - RNA, 19 nt, synthetic construct
  source 1..19: mol_type = other RNA
ttcgagggggcggaggaat

SEQ ID NO: 1824 - RNA, 19 nt, synthetic construct
  source 1..19: mol_type = other RNA
cggaggaatatgccagctt

SEQ ID NO: 1825 - RNA, 19 nt, synthetic construct
  source 1..19: mol_type = other RNA
cagcttcctgcaggaggcg

SEQ ID NO: 1826 - RNA, 19 nt, synthetic construct
  source 1..19: mol_type = other RNA
aggaggcgcaggtaccgtt

SEQ ID NO: 1827 - RNA, 19 nt, synthetic construct
  source 1..19: mol_type = other RNA
aggtaccgttcctctccct

SEQ ID NO: 1828 - RNA, 19 nt, synthetic construct
  source 1..19: mol_type = other RNA
ctctccctggagcgctgct

SEQ ID NO: 1829 - RNA, 19 nt, synthetic construct
  source 1..19: mol_type = other RNA
cgctgctcagccccggacg

SEQ ID NO: 1830 - RNA, 19 nt, synthetic construct
  source 1..19: mol_type = other RNA
ccggacgtgcacggatcct

SEQ ID NO: 1831 - RNA, 19 nt, synthetic construct
  source 1..19: mol_type = other RNA
cggatcctccatcctcccc

SEQ ID NO: 1832 - RNA, 19 nt, synthetic construct
  source 1..19: mol_type = other RNA
catcctccccggcatgctc

SEQ ID NO: 1833 - RNA, 19 nt, synthetic construct
  source 1..19: mol_type = other RNA
catgctctgcgcagggttc

SEQ ID NO: 1834 - RNA, 19 nt, synthetic construct
  source 1..19: mol_type = other RNA
agggttcctcgagggcggc

SEQ ID NO: 1835 - RNA, 19 nt, synthetic construct
  source 1..19: mol_type = other RNA
gagggcggcaccgatgcgt

SEQ ID NO: 1836 - RNA, 19 nt, synthetic construct
  source 1..19: mol_type = other RNA
gatgcgtgccagggtgatt

SEQ ID NO: 1837 - RNA, 19 nt, synthetic construct
  source 1..19: mol_type = other RNA
agggtgattccggaggccc

SEQ ID NO: 1838 - RNA, 19 nt, synthetic construct
  source 1..19: mol_type = other RNA
cggaggcccgctggtgtgt

SEQ ID NO: 1839 - RNA, 19 nt, synthetic construct
  source 1..19: mol_type = other RNA
ggtgtgtgaggaccaagct

SEQ ID NO: 1840 - RNA, 19 nt, synthetic construct
  source 1..19: mol_type = other RNA
ccaagctgcagagcgccgg

SEQ ID NO: 1841 - RNA, 19 nt, synthetic construct
  source 1..19: mol_type = other RNA
agagcgccggctcaccctg

SEQ ID NO: 1842 - RNA, 19 nt, synthetic construct
  source 1..19: mol_type = other RNA
tcaccctgcaaggcatcat

SEQ ID NO: 1843 - RNA, 19 nt, synthetic construct
  source 1..19: mol_type = other RNA
ggcatcatcagctggggat

SEQ ID NO: 1844 - RNA, 19 nt, synthetic construct
  source 1..19: mol_type = other RNA
ctggggatcgggctgtggt

SEQ ID NO: 1845 - RNA, 19 nt, synthetic construct
  source 1..19: mol_type = other RNA
tgtggtgaccgcaacaagc

SEQ ID NO: 1846 - RNA, 19 nt, synthetic construct
  source 1..19: mol_type = other RNA
caacaagccaggcgtctac

SEQ ID NO: 1847 - RNA, 19 nt, synthetic construct
  source 1..19: mol_type = other RNA
aggcgtctacaccgatgtg

SEQ ID NO: 1848 - RNA, 19 nt, synthetic construct
  source 1..19: mol_type = other RNA
gatgtggcctactacctgg

SEQ ID NO: 1849 - RNA, 19 nt, synthetic construct
  source 1..19: mol_type = other RNA
tactacctggcctggatcc

SEQ ID NO: 1850 - RNA, 19 nt, synthetic construct
  source 1..19: mol_type = other RNA
ctggatccgggagcacacc

SEQ ID NO: 1851 - RNA, 19 nt, synthetic construct
  source 1..19: mol_type = other RNA
agcacaccgtttcctgatt

SEQ ID NO: 1852 - RNA, 19 nt, synthetic construct
  source 1..19: mol_type = other RNA
tcctgattgctcagggact

SEQ ID NO: 1853 - RNA, 19 nt, synthetic construct
  source 1..19: mol_type = other RNA
cagggactcatctttccct

SEQ ID NO: 1854 - RNA, 19 nt, synthetic construct
  source 1..19: mol_type = other RNA
tttccctccttggtgattc

SEQ ID NO: 1855 - RNA, 19 nt, synthetic construct
  source 1..19: mol_type = other RNA
tggtgattccgcagtgaga

SEQ ID NO: 1856 - RNA, 19 nt, synthetic construct
  source 1..19: mol_type = other RNA
agtgagagagtggctgggg

SEQ ID NO: 1857 - RNA, 19 nt, synthetic construct
  source 1..19: mol_type = other RNA
gctggggcatggaaggcaa

SEQ ID NO: 1858 - RNA, 19 nt, synthetic construct
  source 1..19: mol_type = other RNA
tggaaggcaagattgtgtc

SEQ ID NO: 1859 - RNA, 19 nt, synthetic construct
  source 1..19: mol_type = other RNA
ttgtgtcccattcccccag

SEQ ID NO: 1860 - RNA, 19 nt, synthetic construct
  source 1..19: mol_type = other RNA
tcccccagtgcggccagct

SEQ ID NO: 1861 - RNA, 19 nt, synthetic construct
  source 1..19: mol_type = other RNA
gccagctccgcgccaggat

SEQ ID NO: 1862 - RNA, 19 nt, synthetic construct
  source 1..19: mol_type = other RNA
gccaggatggcgcaggaac

SEQ ID NO: 1863 - RNA, 19 nt, synthetic construct
  source 1..19: mol_type = other RNA
gcaggaactcaataaagtg

SEQ ID NO: 1864 - RNA, 19 nt, synthetic construct
  source 1..19: mol_type = other RNA
aataaagtgctttgaaaat

SEQ ID NO: 1865 - RNA, 19 nt, synthetic construct
  source 1..19: mol_type = other RNA
ttgaaaatgctgagaaaaa

SEQ ID NO: 1866 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine
aactcaataaagtgctttgaa

SEQ ID NO: 1867 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttcaaagcactttattgagtttc

SEQ ID NO: 1868 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine
aactcaataaagtgctttgaa

SEQ ID NO: 1869 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttcaaagcactttattgagtttc

SEQ ID NO: 1870 - RNA, 19 nt, synthetic construct
  source 1..19: mol_type = other RNA
gccaggatggcgcaggaaa

SEQ ID NO: 1871 - RNA, 19 nt, synthetic construct
  source 1..19: mol_type = other RNA
ccaggatggcgcaggaact

SEQ ID NO: 1872 - RNA, 19 nt, synthetic construct
  source 1..19: mol_type = other RNA
caggatggcgcaggaacta

SEQ ID NO: 1873 - RNA, 19 nt, synthetic construct
  source 1..19: mol_type = other RNA
aggatggcgcaggaactca

SEQ ID NO: 1874 - RNA, 19 nt, synthetic construct
  source 1..19: mol_type = other RNA
ggatggcgcaggaactcaa

SEQ ID NO: 1875 - RNA, 19 nt, synthetic construct
  source 1..19: mol_type = other RNA
gatggcgcaggaactcaat

SEQ ID NO: 1876 - RNA, 19 nt, synthetic construct
  source 1..19: mol_type = other RNA
atggcgcaggaactcaata

SEQ ID NO: 1877 - RNA, 19 nt, synthetic construct
  source 1..19: mol_type = other RNA
tggcgcaggaactcaataa

SEQ ID NO: 1878 - RNA, 19 nt, synthetic construct
  source 1..19: mol_type = other RNA
ggcgcaggaactcaataaa

SEQ ID NO: 1879 - RNA, 19 nt, synthetic construct
  source 1..19: mol_type = other RNA
gcgcaggaactcaataaaa

SEQ ID NO: 1880 - RNA, 19 nt, synthetic construct
  source 1..19: mol_type = other RNA
cgcaggaactcaataaagt

SEQ ID NO: 1881 - RNA, 19 nt, synthetic construct
  source 1..19: mol_type = other RNA
gcaggaactcaataaagta

SEQ ID NO: 1882 - RNA, 19 nt, synthetic construct
  source 1..19: mol_type = other RNA
caggaactcaataaagtga

SEQ ID NO: 1883 - RNA, 19 nt, synthetic construct
  source 1..19: mol_type = other RNA
aggaactcaataaagtgct

SEQ ID NO: 1884 - RNA, 19 nt, synthetic construct
  source 1..19: mol_type = other RNA
ggaactcaataaagtgctt

SEQ ID NO: 1885 - RNA, 19 nt, synthetic construct
  source 1..19: mol_type = other RNA
gaactcaataaagtgcttt

SEQ ID NO: 1886 - RNA, 19 nt, synthetic construct
  source 1..19: mol_type = other RNA
aactcaataaagtgcttta

SEQ ID NO: 1887 - RNA, 19 nt, synthetic construct
  source 1..19: mol_type = other RNA
actcaataaagtgctttga

SEQ ID NO: 1888 - RNA, 19 nt, synthetic construct
  source 1..19: mol_type = other RNA
tcaataaagtgctttgaaa

SEQ ID NO: 1889 - RNA, 19 nt, synthetic construct
  source 1..19: mol_type = other RNA
caataaagtgctttgaaaa

SEQ ID NO: 1890 - RNA, 19 nt, synthetic construct
  source 1..19: mol_type = other RNA
aataaagtgctttgaaaat

SEQ ID NO: 1891 - RNA, 19 nt, synthetic construct
  source 1..19: mol_type = other RNA
ataaagtgctttgaaaata

SEQ ID NO: 1892 - RNA, 19 nt, synthetic construct
  source 1..19: mol_type = other RNA
taaagtgctttgaaaatga

SEQ ID NO: 1893 - RNA, 19 nt, synthetic construct
  source 1..19: mol_type = other RNA
aaagtgctttgaaaatgct

SEQ ID NO: 1894 - RNA, 19 nt, synthetic construct
  source 1..19: mol_type = other RNA
aagtgctttgaaaatgcta

SEQ ID NO: 1895 - RNA, 19 nt, synthetic construct
  source 1..19: mol_type = other RNA
agtgctttgaaaatgctga

SEQ ID NO: 1896 - RNA, 19 nt, synthetic construct
  source 1..19: mol_type = other RNA
gtgctttgaaaatgctgaa

SEQ ID NO: 1897 - RNA, 19 nt, synthetic construct
  source 1..19: mol_type = other RNA
tgctttgaaaatgctgaga

SEQ ID NO: 1898 - RNA, 19 nt, synthetic construct
  source 1..19: mol_type = other RNA
gctttgaaaatgctgagaa

SEQ ID NO: 1899 - RNA, 19 nt, synthetic construct
  source 1..19: mol_type = other RNA
ctttgaaaatgctgagaaa

SEQ ID NO: 1900 - RNA, 19 nt, synthetic construct
  source 1..19: mol_type = other RNA
tttgaaaatgctgagaaaa

SEQ ID NO: 1901 - RNA, 19 nt, synthetic construct
  source 1..19: mol_type = other RNA
ttgaaaatgctgagaaaaa

SEQ ID NO: 1902 - RNA, 19 nt, synthetic construct
  source 1..19: mol_type = other RNA
tgaaaatgctgagaaaaaa

SEQ ID NO: 1903 - RNA, 19 nt, synthetic construct
  source 1..19: mol_type = other RNA
gaaaatgctgagaaaaaaa

SEQ ID NO: 1904 - RNA, 19 nt, synthetic construct
  source 1..19: mol_type = other RNA
aaaatgctgagaaaaaaaa

SEQ ID NO: 1905 - RNA, 19 nt, synthetic construct
  source 1..19: mol_type = other RNA
aaatgctgagaaaaaaaaa

SEQ ID NO: 1906 - RNA, 19 nt, synthetic construct
  source 1..19: mol_type = other RNA
aatgctgagaaaaaaaaaa

SEQ ID NO: 1907 - RNA, 19 nt, synthetic construct
  source 1..19: mol_type = other RNA
atgctgagaaaaaaaaaaa

SEQ ID NO: 1908 - RNA, 19 nt, synthetic construct
  source 1..19: mol_type = other RNA
tttcctgcgccatcctggc

SEQ ID NO: 1909 - RNA, 19 nt, synthetic construct
  source 1..19: mol_type = other RNA
agttcctgcgccatcctgg

SEQ ID NO: 1910 - RNA, 19 nt, synthetic construct
  source 1..19: mol_type = other RNA
tagttcctgcgccatcctg

SEQ ID NO: 1911 - RNA, 19 nt, synthetic construct
  source 1..19: mol_type = other RNA
tgagttcctgcgccatcct

SEQ ID NO: 1912 - RNA, 19 nt, synthetic construct
  source 1..19: mol_type = other RNA
ttgagttcctgcgccatcc

SEQ ID NO: 1913 - RNA, 19 nt, synthetic construct
  source 1..19: mol_type = other RNA
attgagttcctgcgccatc

SEQ ID NO: 1914 - RNA, 19 nt, synthetic construct
  source 1..19: mol_type = other RNA
tattgagttcctgcgccat

SEQ ID NO: 1915 - RNA, 19 nt, synthetic construct
  source 1..19: mol_type = other RNA
ttattgagttcctgcgcca

SEQ ID NO: 1916 - RNA, 19 nt, synthetic construct
  source 1..19: mol_type = other RNA
tttattgagttcctgcgcc

SEQ ID NO: 1917 - RNA, 19 nt, synthetic construct
  source 1..19: mol_type = other RNA
ttttattgagttcctgcgc

SEQ ID NO: 1918 - RNA, 19 nt, synthetic construct
  source 1..19: mol_type = other RNA
actttattgagttcctgcg

SEQ ID NO: 1919 - RNA, 19 nt, synthetic construct
  source 1..19: mol_type = other RNA
tactttattgagttcctgc

SEQ ID NO: 1920 - RNA, 19 nt, synthetic construct
  source 1..19: mol_type = other RNA
tcactttattgagttcctg

SEQ ID NO: 1921 - RNA, 19 nt, synthetic construct
  source 1..19: mol_type = other RNA
agcactttattgagttcct

SEQ ID NO: 1922 - RNA, 19 nt, synthetic construct
  source 1..19: mol_type = other RNA
aagcactttattgagttcc

SEQ ID NO: 1923 - RNA, 19 nt, synthetic construct
  source 1..19: mol_type = other RNA
aaagcactttattgagttc

SEQ ID NO: 1924 - RNA, 19 nt, synthetic construct
  source 1..19: mol_type = other RNA
taaagcactttattgagtt

SEQ ID NO: 1925 - RNA, 19 nt, synthetic construct
  source 1..19: mol_type = other RNA
tcaaagcactttattgagt

SEQ ID NO: 1926 - RNA, 19 nt, synthetic construct
  source 1..19: mol_type = other RNA
tttcaaagcactttattga

SEQ ID NO: 1927 - RNA, 19 nt, synthetic construct
  source 1..19: mol_type = other RNA
ttttcaaagcactttattg

SEQ ID NO: 1928 - RNA, 19 nt, synthetic construct
  source 1..19: mol_type = other RNA
attttcaaagcactttatt

SEQ ID NO: 1929 - RNA, 19 nt, synthetic construct
  source 1..19: mol_type = other RNA
tattttcaaagcactttat

SEQ ID NO: 1930 - RNA, 19 nt, synthetic construct
  source 1..19: mol_type = other RNA
tcattttcaaagcacttta

SEQ ID NO: 1931 - RNA, 19 nt, synthetic construct
  source 1..19: mol_type = other RNA
agcattttcaaagcacttt

SEQ ID NO: 1932 - RNA, 19 nt, synthetic construct
  source 1..19: mol_type = other RNA
tagcattttcaaagcactt

SEQ ID NO: 1933 - RNA, 19 nt, synthetic construct
  source 1..19: mol_type = other RNA
tcagcattttcaaagcact

SEQ ID NO: 1934 - RNA, 19 nt, synthetic construct
  source 1..19: mol_type = other RNA
ttcagcattttcaaagcac

SEQ ID NO: 1935 - RNA, 19 nt, synthetic construct
  source 1..19: mol_type = other RNA
tctcagcattttcaaagca

SEQ ID NO: 1936 - RNA, 19 nt, synthetic construct
  source 1..19: mol_type = other RNA
ttctcagcattttcaaagc

SEQ ID NO: 1937 - RNA, 19 nt, synthetic construct
  source 1..19: mol_type = other RNA
tttctcagcattttcaaag

SEQ ID NO: 1938 - RNA, 19 nt, synthetic construct
  source 1..19: mol_type = other RNA
ttttctcagcattttcaaa

SEQ ID NO: 1939 - RNA, 19 nt, synthetic construct
  source 1..19: mol_type = other RNA
tttttctcagcattttcaa

SEQ ID NO: 1940 - RNA, 19 nt, synthetic construct
  source 1..19: mol_type = other RNA
ttttttctcagcattttca

SEQ ID NO: 1941 - RNA, 19 nt, synthetic construct
  source 1..19: mol_type = other RNA
tttttttctcagcattttc

SEQ ID NO: 1942 - RNA, 19 nt, synthetic construct
  source 1..19: mol_type = other RNA
ttttttttctcagcatttt

SEQ ID NO: 1943 - RNA, 19 nt, synthetic construct
  source 1..19: mol_type = other RNA
tttttttttctcagcattt

SEQ ID NO: 1944 - RNA, 19 nt, synthetic construct
  source 1..19: mol_type = other RNA
ttttttttttctcagcatt

SEQ ID NO: 1945 - RNA, 19 nt, synthetic construct
  source 1..19: mol_type = other RNA
tttttttttttctcagcat

SEQ ID NO: 1946 - DNA, 21 bp, synthetic construct
  source 1..21: mol_type = other DNA
  modified_base 1: mod_base = OTHER; note = guanosine-3'-phosphate
  modified_base 2: mod_base = OTHER; note = cytidine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
gccaggatggcgcaggaaatt

SEQ ID NO: 1947 - DNA, 21 bp, synthetic construct
  source 1..21: mol_type = other DNA
  modified_base 1: mod_base = OTHER; note = cytidine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
ccaggatggcgcaggaacttt

SEQ ID NO: 1948 - DNA, 21 bp, synthetic construct
  source 1..21: mol_type = other DNA
  modified_base 1: mod_base = OTHER; note = cytidine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
caggatggcgcaggaactatt

SEQ ID NO: 1949 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
aggatggcgcaggaactcatt

SEQ ID NO: 1950 - DNA, 21 bp, synthetic construct
  source 1..21: mol_type = other DNA
  modified_base 1: mod_base = OTHER; note = guanosine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
ggatggcgcaggaactcaatt

SEQ ID NO: 1951 - DNA, 21 bp, synthetic construct
  source 1..21: mol_type = other DNA
  modified_base 1: mod_base = OTHER; note = guanosine-3'-phosphate
  modified_base 2: mod_base = OTHER; note = adenosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = uridine-3'-phosphate
  misc_feature 1..19: note = RNA
  misc_feature 20..21: note = DNA
gatggcgcaggaactcaattt

SEQ ID NO: 1952 - DNA, 21 bp, synthetic construct
  source 1..21: mol_type = other DNA
  modified_base 1: mod_base = OTHER; note = adenosine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
atggcgcaggaactcaatatt

SEQ ID NO: 1953 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = uridine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
tggcgcaggaactcaataatt

SEQ ID NO: 1954 - DNA, 21 bp, synthetic construct
  source 1..21: mol_type = other DNA
  modified_base 1: mod_base = OTHER; note = guanosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = uridine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
ggcgcaggaactcaataaatt

SEQ ID NO: 1955 - DNA, 21 bp, synthetic construct
  source 1..21: mol_type = other DNA
  modified_base 1: mod_base = OTHER; note = guanosine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = adenosine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = uridine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
gcgcaggaactcaataaaatt

SEQ ID NO: 1956 - DNA, 21 bp, synthetic construct
  source 1..21: mol_type = other DNA
  modified_base 1: mod_base = OTHER; note = cytidine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = uridine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
cgcaggaactcaataaagttt

SEQ ID NO: 1957 - DNA, 21 bp, synthetic construct
  source 1..21: mol_type = other DNA
  modified_base 1: mod_base = OTHER; note = guanosine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = uridine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
gcaggaactcaataaagtatt

SEQ ID NO: 1958 - DNA, 21 bp, synthetic construct
  source 1..21: mol_type = other DNA
  modified_base 1: mod_base = OTHER; note = cytidine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = adenosine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = uridine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
caggaactcaataaagtgatt

SEQ ID NO: 1959 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = uridine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
aggaactcaataaagtgcttt

SEQ ID NO: 1960 - DNA, 21 bp, synthetic construct
  source 1..21: mol_type = other DNA
  modified_base 1: mod_base = OTHER; note = guanosine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = adenosine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = adenosine-3'-phosphate
  modified_base 10: mod_base = OTHER; note = uridine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
ggaactcaataaagtgctttt

SEQ ID NO: 1961 - DNA, 21 bp, synthetic construct
  source 1..21: mol_type = other DNA
  modified_base 1: mod_base = OTHER; note = guanosine-3'-phosphate
  modified_base 2: mod_base = OTHER; note = adenosine-3'-phosphate
  modified_base 3: mod_base = OTHER; note = adenosine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = uridine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
gaactcaataaagtgcttttt

SEQ ID NO: 1962 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = uridine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = uridine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
aactcaataaagtgctttatt

SEQ ID NO: 1963 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = adenosine-3'-phosphate
  modified_base 7: mod_base = OTHER; note = uridine-3'-phosphate
  modified_base 8: mod_base = OTHER; note = adenosine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = uridine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
actcaataaagtgctttgatt

SEQ ID NO: 1964 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = adenosine-3'-phosphate
  modified_base 5: mod_base = OTHER; note = uridine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
tcaataaagtgctttgaaatt

SEQ ID NO: 1965 - DNA, 21 bp, synthetic construct
  source 1..21: mol_type = other DNA
  modified_base 1: mod_base = OTHER; note = cytidine-3'-phosphate
  modified_base 2: mod_base = OTHER; note = adenosine-3'-phosphate
  modified_base 3: mod_base = OTHER; note = adenosine-3'-phosphate
  modified_base 4: mod_base = OTHER; note = uridine-3'-phosphate
  modified_base 5: mod_base = OTHER; note = adenosine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
caataaagtgctttgaaaatt

SEQ ID NO: 1966 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = uridine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = uridine-3'-phosphate
  misc_feature 1..19: note = RNA
  misc_feature 20..21: note = DNA
aataaagtgctttgaaaattt

SEQ ID NO: 1967 - DNA, 21 bp, synthetic construct
  source 1..21: mol_type = other DNA
  modified_base 1: mod_base = OTHER; note = adenosine-3'-phosphate
  modified_base 2: mod_base = OTHER; note = uridine-3'-phosphate
  modified_base 3: mod_base = OTHER; note = adenosine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = uridine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
ataaagtgctttgaaaatatt

SEQ ID NO: 1968 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = adenosine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = uridine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
taaagtgctttgaaaatgatt

SEQ ID NO: 1969 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
aaagtgctttgaaaatgcttt

SEQ ID NO: 1970 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
aagtgctttgaaaatgctatt

SEQ ID NO: 1971 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
agtgctttgaaaatgctgatt

SEQ ID NO: 1972 - DNA, 21 bp, synthetic construct
  source 1..21: mol_type = other DNA
  modified_base 1: mod_base = OTHER; note = guanosine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
gtgctttgaaaatgctgaatt

SEQ ID NO: 1973 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
tgctttgaaaatgctgagatt

SEQ ID NO: 1974 - DNA, 21 bp, synthetic construct
  source 1..21: mol_type = other DNA
  modified_base 1: mod_base = OTHER; note = guanosine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = uridine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
gctttgaaaatgctgagaatt

SEQ ID NO: 1975 - DNA, 21 bp, synthetic construct
  source 1..21: mol_type = other DNA
  modified_base 1: mod_base = OTHER; note = cytidine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = adenosine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
ctttgaaaatgctgagaaatt

SEQ ID NO: 1976 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
tttgaaaatgctgagaaaatt

SEQ ID NO: 1977 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
ttgaaaatgctgagaaaaatt

SEQ ID NO: 1978 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = adenosine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
tgaaaatgctgagaaaaaatt

SEQ ID NO: 1979 - DNA, 21 bp, synthetic construct
  source 1..21: mol_type = other DNA
  modified_base 1: mod_base = OTHER; note = guanosine-3'-phosphate
  modified_base 2: mod_base = OTHER; note = adenosine-3'-phosphate
  modified_base 3: mod_base = OTHER; note = adenosine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
gaaaatgctgagaaaaaaatt

SEQ ID NO: 1980 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = adenosine-3'-phosphate
  modified_base 4: mod_base = OTHER; note = adenosine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
aaaatgctgagaaaaaaaatt

SEQ ID NO: 1981 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = adenosine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
aaatgctgagaaaaaaaaatt

SEQ ID NO: 1982 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
aatgctgagaaaaaaaaaatt

SEQ ID NO: 1983 - DNA, 21 bp, synthetic construct
  source 1..21: mol_type = other DNA
  modified_base 1: mod_base = OTHER; note = adenosine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
atgctgagaaaaaaaaaaatt

SEQ ID NO: 1984 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = guanosine-3'-phosphate
  modified_base 19: mod_base = OTHER; note = cytidine-3'-phosphate
  misc_feature 1..19: note = RNA
  misc_feature 20..21: note = DNA
tttcctgcgccatcctggctt

SEQ ID NO: 1985 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = guanosine-3'-phosphate
  misc_feature 1..19: note = RNA
  misc_feature 20..21: note = DNA
agttcctgcgccatcctggtt

SEQ ID NO: 1986 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = guanosine-3'-phosphate
  misc_feature 1..19: note = RNA
  misc_feature 20..21: note = DNA
tagttcctgcgccatcctgtt

SEQ ID NO: 1987 - DNA, 21 bp, synthetic construct
  source 1..21: mol_type = other DNA
  modified_base 1: mod_base = OTHER; note = uridine-3'-phosphate
  modified_base 2: mod_base = OTHER; note = guanosine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = uridine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tgagttcctgcgccatccttt

SEQ ID NO: 1988 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = cytidine-3'-phosphate
  misc_feature 1..19: note = RNA
  misc_feature 20..21: note = DNA
ttgagttcctgcgccatcctt

SEQ ID NO: 1989 - DNA, 21 bp, synthetic construct
  source 1..21: mol_type = other DNA
  modified_base 1: mod_base = OTHER; note = adenosine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = guanosine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = uridine-3'-phosphate
  modified_base 19: mod_base = OTHER; note = cytidine-3'-phosphate
  misc_feature 1..19: note = RNA
  misc_feature 20..21: note = DNA
attgagttcctgcgccatctt

SEQ ID NO: 1990 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = guanosine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = uridine-3'-phosphate
  misc_feature 1..19: note = RNA
  misc_feature 20..21: note = DNA
tattgagttcctgcgccattt

SEQ ID NO: 1991 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = adenosine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = guanosine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
ttattgagttcctgcgccatt

SEQ ID NO: 1992 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = adenosine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = uridine-3'-phosphate
  modified_base 11: mod_base = OTHER; note = uridine-3'-phosphate
  modified_base 12: mod_base = OTHER; note = cytidine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = cytidine-3'-phosphate
  misc_feature 1..19: note = RNA
  misc_feature 20..21: note = DNA
tttattgagttcctgcgcctt

SEQ ID NO: 1993 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = adenosine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = guanosine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = uridine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = guanosine-3'-phosphate
  modified_base 19: mod_base = OTHER; note = cytidine-3'-phosphate
  misc_feature 1..19: note = RNA
  misc_feature 20..21: note = DNA
ttttattgagttcctgcgctt

SEQ ID NO: 1994 - DNA, 21 bp, synthetic construct
  source 1..21: mol_type = other DNA
  modified_base 1: mod_base = OTHER; note = adenosine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = adenosine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = guanosine-3'-phosphate
  misc_feature 1..19: note = RNA
  misc_feature 20..21: note = DNA
actttattgagttcctgcgtt

SEQ ID NO: 1995 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = adenosine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = guanosine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = cytidine-3'-phosphate
  misc_feature 1..19: note = RNA
  misc_feature 20..21: note = DNA
tactttattgagttcctgctt

SEQ ID NO: 1996 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = adenosine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = guanosine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = uridine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = guanosine-3'-phosphate
  misc_feature 1..19: note = RNA
  misc_feature 20..21: note = DNA
tcactttattgagttcctgtt

SEQ ID NO: 1997 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = adenosine-3'-phosphate
  modified_base 10: mod_base = OTHER; note = uridine-3'-phosphate
  modified_base 11: mod_base = OTHER; note = uridine-3'-phosphate
  modified_base 12: mod_base = OTHER; note = guanosine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = uridine-3'-phosphate
  modified_base 16: mod_base = OTHER; note = uridine-3'-phosphate
  modified_base 17: mod_base = OTHER; note = cytidine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
agcactttattgagttccttt

SEQ ID NO: 1998 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = adenosine-3'-phosphate
  modified_base 11: mod_base = OTHER; note = uridine-3'-phosphate
  modified_base 12: mod_base = OTHER; note = uridine-3'-phosphate
  modified_base 13: mod_base = OTHER; note = guanosine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = uridine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = cytidine-3'-phosphate
  misc_feature 1..19: note = RNA
  misc_feature 20..21: note = DNA
aagcactttattgagttcctt

SEQ ID NO: 1999 - DNA, 21 bp, synthetic construct
  source 1..21: mol_type = other DNA
  modified_base 1: mod_base = OTHER; note = adenosine-3'-phosphate
  modified_base 2: mod_base = OTHER; note = adenosine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = adenosine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = guanosine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = uridine-3'-phosphate
  modified_base 18: mod_base = OTHER; note = uridine-3'-phosphate
  modified_base 19: mod_base = OTHER; note = cytidine-3'-phosphate
  misc_feature 1..19: note = RNA
  misc_feature 20..21: note = DNA
aaagcactttattgagttctt

SEQ ID NO: 2000 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = adenosine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = uridine-3'-phosphate
  modified_base 12: mod_base = OTHER; note = adenosine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
taaagcactttattgagtttt

SEQ ID NO: 2001 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = uridine-3'-phosphate
  modified_base 12: mod_base = OTHER; note = uridine-3'-phosphate
  modified_base 13: mod_base = OTHER; note = adenosine-3'-phosphate
  modified_base 14: mod_base = OTHER; note = uridine-3'-phosphate
  modified_base 15: mod_base = OTHER; note = uridine-3'-phosphate
  modified_base 16: mod_base = OTHER; note = guanosine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = uridine-3'-phosphate
  misc_feature 1..19: note = RNA
  misc_feature 20..21: note = DNA
tcaaagcactttattgagttt

SEQ ID NO: 2002 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = adenosine-3'-phosphate
  modified_base 16: mod_base = OTHER; note = uridine-3'-phosphate
  modified_base 17: mod_base = OTHER; note = uridine-3'-phosphate
  modified_base 18: mod_base = OTHER; note = guanosine-3'-phosphate
  modified_base 19: mod_base = OTHER; note = adenosine-3'-phosphate
  misc_feature 1..19: note = RNA
  misc_feature 20..21: note = DNA
tttcaaagcactttattgatt

SEQ ID NO: 2003 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = uridine-3'-phosphate
  modified_base 16: mod_base = OTHER; note = adenosine-3'-phosphate
  modified_base 17: mod_base = OTHER; note = uridine-3'-phosphate
  modified_base 18: mod_base = OTHER; note = uridine-3'-phosphate
  modified_base 19: mod_base = OTHER; note = guanosine-3'-phosphate
  misc_feature 1..19: note = RNA
  misc_feature 20..21: note = DNA
ttttcaaagcactttattgtt

SEQ ID NO: 2004 - DNA, 21 bp, synthetic construct
  source 1..21: mol_type = other DNA
  modified_base 1: mod_base = OTHER; note = adenosine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = adenosine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = cytidine-3'-phosphate
  modified_base 14: mod_base = OTHER; note = uridine-3'-phosphate
  modified_base 15: mod_base = OTHER; note = uridine-3'-phosphate
  modified_base 16: mod_base = OTHER; note = uridine-3'-phosphate
  modified_base 17: mod_base = OTHER; note = adenosine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
attttcaaagcactttatttt

SEQ ID NO: 2005 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = cytidine-3'-phosphate
  modified_base 15: mod_base = OTHER; note = uridine-3'-phosphate
  modified_base 16: mod_base = OTHER; note = uridine-3'-phosphate
  modified_base 17: mod_base = OTHER; note = uridine-3'-phosphate
  modified_base 18: mod_base = OTHER; note = adenosine-3'-phosphate
  modified_base 19: mod_base = OTHER; note = uridine-3'-phosphate
  misc_feature 1..19: note = RNA
  misc_feature 20..21: note = DNA
tattttcaaagcactttattt

SEQ ID NO: 2006 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = cytidine-3'-phosphate
  modified_base 16: mod_base = OTHER; note = uridine-3'-phosphate
  modified_base 17: mod_base = OTHER; note = uridine-3'-phosphate
  modified_base 18: mod_base = OTHER; note = uridine-3'-phosphate
  modified_base 19: mod_base = OTHER; note = adenosine-3'-phosphate
  misc_feature 1..19: note = RNA
  misc_feature 20..21: note = DNA
tcattttcaaagcactttatt

SEQ ID NO: 2007 - DNA, 21 bp, synthetic construct
  source 1..21: mol_type = other DNA
  modified_base 1: mod_base = OTHER; note = adenosine-3'-phosphate
  modified_base 2: mod_base = OTHER; note = guanosine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = cytidine-3'-phosphate
  modified_base 17: mod_base = OTHER; note = uridine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
agcattttcaaagcacttttt

SEQ ID NO: 2008 - DNA, 21 bp, synthetic construct
  source 1..21: mol_type = other DNA
  modified_base 1: mod_base = OTHER; note = uridine-3'-phosphate
  modified_base 2: mod_base = OTHER; note = adenosine-3'-phosphate
  modified_base 3: mod_base = OTHER; note = guanosine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = cytidine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
tagcattttcaaagcactttt

SEQ ID NO: 2009 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = adenosine-3'-phosphate
  modified_base 4: mod_base = OTHER; note = guanosine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = cytidine-3'-phosphate
  modified_base 19: mod_base = OTHER; note = uridine-3'-phosphate
  misc_feature 1..19: note = RNA
  misc_feature 20..21: note = DNA
tcagcattttcaaagcacttt

SEQ ID NO: 2010 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = cytidine-3'-phosphate
  modified_base 4: mod_base = OTHER; note = adenosine-3'-phosphate
  modified_base 5: mod_base = OTHER; note = guanosine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = uridine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = cytidine-3'-phosphate
  misc_feature 1..19: note = RNA
  misc_feature 20..21: note = DNA
ttcagcattttcaaagcactt

SEQ ID NO: 2011 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = uridine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = guanosine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
tctcagcattttcaaagcatt

SEQ ID NO: 2012 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = cytidine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = cytidine-3'-phosphate
  modified_base 9: mod_base = OTHER; note = adenosine-3'-phosphate
  modified_base 10: mod_base = OTHER; note = uridine-3'-phosphate
  modified_base 11: mod_base = OTHER; note = uridine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = guanosine-3'-phosphate
  modified_base 19: mod_base = OTHER; note = cytidine-3'-phosphate
  misc_feature 1..19: note = RNA
  misc_feature 20..21: note = DNA
ttctcagcattttcaaagctt

SEQ ID NO: 2013 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = cytidine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = adenosine-3'-phosphate
  modified_base 8: mod_base = OTHER; note = guanosine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = uridine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = guanosine-3'-phosphate
  misc_feature 1..19: note = RNA
  misc_feature 20..21: note = DNA
tttctcagcattttcaaagtt

SEQ ID NO: 2014 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = cytidine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = adenosine-3'-phosphate
  modified_base 9: mod_base = OTHER; note = guanosine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = uridine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = uridine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
ttttctcagcattttcaaatt

SEQ ID NO: 2015 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = cytidine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = adenosine-3'-phosphate
  modified_base 10: mod_base = OTHER; note = guanosine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = uridine-3'-phosphate
  modified_base 14: mod_base = OTHER; note = uridine-3'-phosphate
  modified_base 15: mod_base = OTHER; note = uridine-3'-phosphate
  modified_base 16: mod_base = OTHER; note = uridine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = adenosine-3'-phosphate
  misc_feature 1..19: note = RNA
  misc_feature 20..21: note = DNA
tttttctcagcattttcaatt

SEQ ID NO: 2016 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = cytidine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = uridine-3'-phosphate
  modified_base 15: mod_base = OTHER; note = uridine-3'-phosphate
  modified_base 16: mod_base = OTHER; note = uridine-3'-phosphate
  modified_base 17: mod_base = OTHER; note = uridine-3'-phosphate
  modified_base 18: mod_base = OTHER; note = cytidine-3'-phosphate
  modified_base 19: mod_base = OTHER; note = adenosine-3'-phosphate
  misc_feature 1..19: note = RNA
  misc_feature 20..21: note = DNA
ttttttctcagcattttcatt

SEQ ID NO: 2017 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = cytidine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = adenosine-3'-phosphate
  modified_base 12: mod_base = OTHER; note = guanosine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = uridine-3'-phosphate
  modified_base 16: mod_base = OTHER; note = uridine-3'-phosphate
  modified_base 17: mod_base = OTHER; note = uridine-3'-phosphate
  modified_base 18: mod_base = OTHER; note = uridine-3'-phosphate
  modified_base 19: mod_base = OTHER; note = cytidine-3'-phosphate
  misc_feature 1..19: note = RNA
  misc_feature 20..21: note = DNA
tttttttctcagcattttctt

SEQ ID NO: 2018 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = uridine-3'-phosphate
  modified_base 17: mod_base = OTHER; note = uridine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
ttttttttctcagcatttttt

SEQ ID NO: 2019 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = cytidine-3'-phosphate
  modified_base 11: mod_base = OTHER; note = uridine-3'-phosphate
  modified_base 12: mod_base = OTHER; note = cytidine-3'-phosphate
  modified_base 13: mod_base = OTHER; note = adenosine-3'-phosphate
  modified_base 14: mod_base = OTHER; note = guanosine-3'-phosphate
  modified_base 15: mod_base = OTHER; note = cytidine-3'-phosphate
  modified_base 16: mod_base = OTHER; note = adenosine-3'-phosphate
  modified_base 17: mod_base = OTHER; note = uridine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
tttttttttctcagcattttt

SEQ ID NO: 2020 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = cytidine-3'-phosphate
  modified_base 12: mod_base = OTHER; note = uridine-3'-phosphate
  modified_base 13: mod_base = OTHER; note = cytidine-3'-phosphate
  modified_base 14: mod_base = OTHER; note = adenosine-3'-phosphate
  modified_base 15: mod_base = OTHER; note = guanosine-3'-phosphate
  modified_base 16: mod_base = OTHER; note = cytidine-3'-phosphate
  modified_base 17: mod_base = OTHER; note = adenosine-3'-phosphate
  modified_base 18: mod_base = OTHER; note = uridine-3'-phosphate
  modified_base 19: mod_base = OTHER; note = uridine-3'-phosphate
  misc_feature 1..19: note = RNA
  misc_feature 20..21: note = DNA
ttttttttttctcagcatttt

SEQ ID NO: 2021 - DNA, 21 bp, synthetic construct
  source 1..21: mol_type = other DNA
  modified_base 1: mod_base = OTHER; note = uridine-3'-phosphate
  modified_base 2: mod_base = OTHER; note = uridine-3'-phosphate
  modified_base 3: mod_base = OTHER; note = uridine-3'-phosphate
  modified_base 4: mod_base = OTHER; note = uridine-3'-phosphate
  modified_base 5: mod_base = OTHER; note = uridine-3'-phosphate
  modified_base 6: mod_base = OTHER; note = uridine-3'-phosphate
  modified_base 7: mod_base = OTHER; note = uridine-3'-phosphate
  modified_base 8: mod_base = OTHER; note = uridine-3'-phosphate
  modified_base 9: mod_base = OTHER; note = uridine-3'-phosphate
  modified_base 10: mod_base = OTHER; note = uridine-3'-phosphate
  modified_base 11: mod_base = OTHER; note = uridine-3'-phosphate
  modified_base 12: mod_base = OTHER; note = cytidine-3'-phosphate
  modified_base 13: mod_base = OTHER; note = uridine-3'-phosphate
  modified_base 14: mod_base = OTHER; note = cytidine-3'-phosphate
  modified_base 15: mod_base = OTHER; note = adenosine-3'-phosphate
  modified_base 16: mod_base = OTHER; note = guanosine-3'-phosphate
  modified_base 17: mod_base = OTHER; note = cytidine-3'-phosphate
  modified_base 18: mod_base = OTHER; note = adenosine-3'-phosphate
  modified_base 19: mod_base = OTHER; note = uridine-3'-phosphate
  misc_feature 1..19: note = RNA
  misc_feature 20..21: note = DNA
tttttttttttctcagcattt

SEQ ID NO: 2022 - RNA, 19 nt, synthetic construct
  source 1..19: mol_type = other RNA
gccaggatggcgcaggaac

SEQ ID NO: 2023 - RNA, 19 nt, synthetic construct
  source 1..19: mol_type = other RNA
ccaggatggcgcaggaact

SEQ ID NO: 2024 - RNA, 19 nt, synthetic construct
  source 1..19: mol_type = other RNA
caggatggcgcaggaactc

SEQ ID NO: 2025 - RNA, 19 nt, synthetic construct
  source 1..19: mol_type = other RNA
aggatggcgcaggaactca

SEQ ID NO: 2026 - RNA, 19 nt, synthetic construct
  source 1..19: mol_type = other RNA
ggatggcgcaggaactcaa

SEQ ID NO: 2027 - RNA, 19 nt, synthetic construct
  source 1..19: mol_type = other RNA
gatggcgcaggaactcaat

SEQ ID NO: 2028 - RNA, 19 nt, synthetic construct
  source 1..19: mol_type = other RNA
atggcgcaggaactcaata

SEQ ID NO: 2029 - RNA, 19 nt, synthetic construct
  source 1..19: mol_type = other RNA
tggcgcaggaactcaataa

SEQ ID NO: 2030 - RNA, 19 nt, synthetic construct
  source 1..19: mol_type = other RNA
ggcgcaggaactcaataaa

SEQ ID NO: 2031 - RNA, 19 nt, synthetic construct
  source 1..19: mol_type = other RNA
gcgcaggaactcaataaag

SEQ ID NO: 2032 - RNA, 19 nt, synthetic construct
  source 1..19: mol_type = other RNA
cgcaggaactcaataaagt

SEQ ID NO: 2033 - RNA, 19 nt, synthetic construct
  source 1..19: mol_type = other RNA
gcaggaactcaataaagtg

SEQ ID NO: 2034 - RNA, 19 nt, synthetic construct
  source 1..19: mol_type = other RNA
caggaactcaataaagtgc

SEQ ID NO: 2035 - RNA, 19 nt, synthetic construct
  source 1..19: mol_type = other RNA
aggaactcaataaagtgct

SEQ ID NO: 2036 - RNA, 19 nt, synthetic construct
  source 1..19: mol_type = other RNA
ggaactcaataaagtgctt

SEQ ID NO: 2037 - RNA, 19 nt, synthetic construct
  source 1..19: mol_type = other RNA
gaactcaataaagtgcttt

SEQ ID NO: 2038 - RNA, 19 nt, synthetic construct
  source 1..19: mol_type = other RNA
aactcaataaagtgctttg

SEQ ID NO: 2039 - RNA, 19 nt, synthetic construct
  source 1..19: mol_type = other RNA
actcaataaagtgctttga

SEQ ID NO: 2040 - RNA, 19 nt, synthetic construct
  source 1..19: mol_type = other RNA
tcaataaagtgctttgaaa

SEQ ID NO: 2041 - RNA, 19 nt, synthetic construct
  source 1..19: mol_type = other RNA
caataaagtgctttgaaaa

SEQ ID NO: 2042 - RNA, 19 nt, synthetic construct
  source 1..19: mol_type = other RNA
aataaagtgctttgaaaat

SEQ ID NO: 2043 - RNA, 19 nt, synthetic construct
  source 1..19: mol_type = other RNA
ataaagtgctttgaaaatg

SEQ ID NO: 2044 - RNA, 19 nt, synthetic construct
  source 1..19: mol_type = other RNA
taaagtgctttgaaaatgc

SEQ ID NO: 2045 - RNA, 19 nt, synthetic construct
  source 1..19: mol_type = other RNA
aaagtgctttgaaaatgct

SEQ ID NO: 2046 - RNA, 19 nt, synthetic construct
  source 1..19: mol_type = other RNA
aagtgctttgaaaatgctg

SEQ ID NO: 2047 - RNA, 19 nt, synthetic construct
  source 1..19: mol_type = other RNA
agtgctttgaaaatgctga

SEQ ID NO: 2048 - RNA, 19 nt, synthetic construct
  source 1..19: mol_type = other RNA
gtgctttgaaaatgctgag

SEQ ID NO: 2049 - RNA, 19 nt, synthetic construct
  source 1..19: mol_type = other RNA
tgctttgaaaatgctgaga

SEQ ID NO: 2050 - RNA, 19 nt, synthetic construct
  source 1..19: mol_type = other RNA
gctttgaaaatgctgagaa

SEQ ID NO: 2051 - RNA, 19 nt, synthetic construct
  source 1..19: mol_type = other RNA
ctttgaaaatgctgagaaa

SEQ ID NO: 2052 - RNA, 19 nt, synthetic construct
  source 1..19: mol_type = other RNA
tttgaaaatgctgagaaaa

SEQ ID NO: 2053 - RNA, 19 nt, synthetic construct
  source 1..19: mol_type = other RNA
ttgaaaatgctgagaaaaa

SEQ ID NO: 2054 - RNA, 19 nt, synthetic construct
  source 1..19: mol_type = other RNA
tgaaaatgctgagaaaaaa

SEQ ID NO: 2055 - RNA, 19 nt, synthetic construct
  source 1..19: mol_type = other RNA
gaaaatgctgagaaaaaaa

SEQ ID NO: 2056 - RNA, 19 nt, synthetic construct
  source 1..19: mol_type = other RNA
aaaatgctgagaaaaaaaa

SEQ ID NO: 2057 - RNA, 19 nt, synthetic construct
  source 1..19: mol_type = other RNA
aaatgctgagaaaaaaaaa

SEQ ID NO: 2058 - RNA, 19 nt, synthetic construct
  source 1..19: mol_type = other RNA
aatgctgagaaaaaaaaaa

SEQ ID NO: 2059 - RNA, 19 nt, synthetic construct
  source 1..19: mol_type = other RNA
atgctgagaaaaaaaaaaa

SEQ ID NO: 2060 - RNA, 21 nt, synthetic construct
  source 1..21: mol_type = other RNA
ggagcccaagaaagtgaaaga

SEQ ID NO: 2061 - RNA, 21 nt, synthetic construct
  source 1..21: mol_type = other RNA
ggagcccaagaaagtgaaaga

SEQ ID NO: 2062 - RNA, 21 nt, synthetic construct
  source 1..21: mol_type = other RNA
gagcccaagaaagtgaaagaa

SEQ ID NO: 2063 - RNA, 21 nt, synthetic construct
  source 1..21: mol_type = other RNA
gagcccaagaaagtgaaagaa

SEQ ID NO: 2064 - RNA, 21 nt, synthetic construct
  source 1..21: mol_type = other RNA
gcccaagaaagtgaaagacca

SEQ ID NO: 2065 - RNA, 21 nt, synthetic construct
  source 1..21: mol_type = other RNA
gcccaagaaagtgaaagacca

SEQ ID NO: 2066 - RNA, 21 nt, synthetic construct
  source 1..21: mol_type = other RNA
cccaagaaagtgaaagaccaa

SEQ ID NO: 2067 - RNA, 21 nt, synthetic construct
  source 1..21: mol_type = other RNA
cccaagaaagtgaaagaccaa

SEQ ID NO: 2068 - RNA, 21 nt, synthetic construct
  source 1..21: mol_type = other RNA
aaagagaaatgctttgagcca

SEQ ID NO: 2069 - RNA, 21 nt, synthetic construct
  source 1..21: mol_type = other RNA
aaagagaaatgctttgagcca

SEQ ID NO: 2070 - RNA, 21 nt, synthetic construct
  source 1..21: mol_type = other RNA
aagagaaatgctttgagccta

SEQ ID NO: 2071 - RNA, 21 nt, synthetic construct
  source 1..21: mol_type = other RNA
aagagaaatgctttgagccta

SEQ ID NO: 2072 - RNA, 21 nt, synthetic construct
  source 1..21: mol_type = other RNA
agagaaatgctttgagcctca

SEQ ID NO: 2073 - RNA, 21 nt, synthetic construct
  source 1..21: mol_type = other RNA
agagaaatgctttgagcctca

SEQ ID NO: 2074 - RNA, 21 nt, synthetic construct
  source 1..21: mol_type = other RNA
gagaaatgctttgagcctcaa

SEQ ID NO: 2075 - RNA, 21 nt, synthetic construct
  source 1..21: mol_type = other RNA
gagaaatgctttgagcctcaa

SEQ ID NO: 2076 - RNA, 21 nt, synthetic construct
  source 1..21: mol_type = other RNA
agaaatgctttgagcctcaga

SEQ ID NO: 2077 - RNA, 21 nt, synthetic construct
  source 1..21: mol_type = other RNA
agaaatgctttgagcctcaga

SEQ ID NO: 2078 - RNA, 21 nt, synthetic construct
  source 1..21: mol_type = other RNA
aaatgctttgagcctcagcta

SEQ ID NO: 2079 - RNA, 21 nt, synthetic construct
  source 1..21: mol_type = other RNA
aaatgctttgagcctcagcta

SEQ ID NO: 2080 - RNA, 21 nt, synthetic construct
  source 1..21: mol_type = other RNA
atgctttgagcctcagcttca

SEQ ID NO: 2081 - RNA, 21 nt, synthetic construct
  source 1..21: mol_type = other RNA
atgctttgagcctcagcttca

SEQ ID NO: 2082 - RNA, 21 nt, synthetic construct
  source 1..21: mol_type = other RNA
tgctttgagcctcagcttcta

SEQ ID NO: 2083 - RNA, 21 nt, synthetic construct
  source 1..21: mol_type = other RNA
tgctttgagcctcagcttcta

SEQ ID NO: 2084 - RNA, 21 nt, synthetic construct
  source 1..21: mol_type = other RNA
gctttgagcctcagcttctca

SEQ ID NO: 2085 - RNA, 21 nt, synthetic construct
  source 1..21: mol_type = other RNA
gctttgagcctcagcttctca

SEQ ID NO: 2086 - RNA, 21 nt, synthetic construct
  source 1..21: mol_type = other RNA
actccaccttcctgcaggaga

SEQ ID NO: 2087 - RNA, 21 nt, synthetic construct
  source 1..21: mol_type = other RNA
actccaccttcctgcaggaga

SEQ ID NO: 2088 - RNA, 21 nt, synthetic construct
  source 1..21: mol_type = other RNA
cacagaaactcaataaagtga

SEQ ID NO: 2089 - RNA, 21 nt, synthetic construct
  source 1..21: mol_type = other RNA
cacagaaactcaataaagtga

SEQ ID NO: 2090 - RNA, 21 nt, synthetic construct
  source 1..21: mol_type = other RNA
acagaaactcaataaagtgca

SEQ ID NO: 2091 - RNA, 21 nt, synthetic construct
  source 1..21: mol_type = other RNA
acagaaactcaataaagtgca

SEQ ID NO: 2092 - RNA, 21 nt, synthetic construct
  source 1..21: mol_type = other RNA
cagaaactcaataaagtgcta

SEQ ID NO: 2093 - RNA, 21 nt, synthetic construct
  source 1..21: mol_type = other RNA
cagaaactcaataaagtgcta

SEQ ID NO: 2094 - RNA, 21 nt, synthetic construct
  source 1..21: mol_type = other RNA
agaaactcaataaagtgctta

SEQ ID NO: 2095 - RNA, 21 nt, synthetic construct
  source 1..21: mol_type = other RNA
agaaactcaataaagtgctta

SEQ ID NO: 2096 - RNA, 21 nt, synthetic construct
  source 1..21: mol_type = other RNA
gaaactcaataaagtgcttta

SEQ ID NO: 2097 - RNA, 21 nt, synthetic construct
  source 1..21: mol_type = other RNA
gaaactcaataaagtgcttta

SEQ ID NO: 2098 - RNA, 21 nt, synthetic construct
  source 1..21: mol_type = other RNA
aaactcaataaagtgctttga

SEQ ID NO: 2099 - RNA, 21 nt, synthetic construct
  source 1..21: mol_type = other RNA
aaactcaataaagtgctttga

SEQ ID NO: 2100 - RNA, 21 nt, synthetic construct
  source 1..21: mol_type = other RNA
actcaataaagtgctttgaaa

SEQ ID NO: 2101 - RNA, 21 nt, synthetic construct
  source 1..21: mol_type = other RNA
actcaataaagtgctttgaaa

SEQ ID NO: 2102 - RNA, 21 nt, synthetic construct
  source 1..21: mol_type = other RNA
tcaataaagtgctttgaaaaa

SEQ ID NO: 2103 - RNA, 21 nt, synthetic construct
  source 1..21: mol_type = other RNA
tcaataaagtgctttgaaaaa

SEQ ID NO: 2104 - RNA, 21 nt, synthetic construct
  source 1..21: mol_type = other RNA
aactcaataaagtgctttgaa

SEQ ID NO: 2105 - RNA, 23 nt, synthetic construct
  source 1..23: mol_type = other RNA
tctttcactttcttgggctccaa

SEQ ID NO: 2106 - RNA, 23 nt, synthetic construct
  source 1..23: mol_type = other RNA
tctttcactttcttgggctccaa

SEQ ID NO: 2107 - RNA, 23 nt, synthetic construct
  source 1..23: mol_type = other RNA
ttctttcactttcttgggctcca

SEQ ID NO: 2108 - RNA, 23 nt, synthetic construct
  source 1..23: mol_type = other RNA
ttctttcactttcttgggctcca

SEQ ID NO: 2109 - RNA, 23 nt, synthetic construct
  source 1..23: mol_type = other RNA
tggtctttcactttcttgggctc

SEQ ID NO: 2110 - RNA, 23 nt, synthetic construct
  source 1..23: mol_type = other RNA
tggtctttcactttcttgggctc

SEQ ID NO: 2111 - RNA, 23 nt, synthetic construct
  source 1..23: mol_type = other RNA
ttggtctttcactttcttgggct

SEQ ID NO: 2112 - RNA, 23 nt, synthetic construct
  source 1..23: mol_type = other RNA
ttggtctttcactttcttgggct

SEQ ID NO: 2113 - RNA, 23 nt, synthetic construct
  source 1..23: mol_type = other RNA
tggctcaaagcatttctctttct

SEQ ID NO: 2114 - RNA, 23 nt, synthetic construct
  source 1..23: mol_type = other RNA
tggctcaaagcatttctctttct

SEQ ID NO: 2115 - RNA, 23 nt, synthetic construct
  source 1..23: mol_type = other RNA
taggctcaaagcatttctctttc

SEQ ID NO: 2116 - RNA, 23 nt, synthetic construct
  source 1..23: mol_type = other RNA
taggctcaaagcatttctctttc

SEQ ID NO: 2117 - RNA, 23 nt, synthetic construct
  source 1..23: mol_type = other RNA
tgaggctcaaagcatttctcttt

SEQ ID NO: 2118 - RNA, 23 nt, synthetic construct
  source 1..23: mol_type = other RNA
tgaggctcaaagcatttctcttt

SEQ ID NO: 2119 - RNA, 23 nt, synthetic construct
  source 1..23: mol_type = other RNA
ttgaggctcaaagcatttctctt

SEQ ID NO: 2120 - RNA, 23 nt, synthetic construct
  source 1..23: mol_type = other RNA
ttgaggctcaaagcatttctctt

SEQ ID NO: 2121 - RNA, 23 nt, synthetic construct
  source 1..23: mol_type = other RNA
tctgaggctcaaagcatttctct

SEQ ID NO: 2122 - RNA, 23 nt, synthetic construct
  source 1..23: mol_type = other RNA
tctgaggctcaaagcatttctct

SEQ ID NO: 2123 - RNA, 23 nt, synthetic construct
  source 1..23: mol_type = other RNA
tagctgaggctcaaagcatttct

SEQ ID NO: 2124 - RNA, 23 nt, synthetic construct
  source 1..23: mol_type = other RNA
tagctgaggctcaaagcatttct

SEQ ID NO: 2125 - RNA, 23 nt, synthetic construct
  source 1..23: mol_type = other RNA
tgaagctgaggctcaaagcattt

SEQ ID NO: 2126 - RNA, 23 nt, synthetic construct
  source 1..23: mol_type = other RNA
tgaagctgaggctcaaagcattt

SEQ ID NO: 2127 - RNA, 23 nt, synthetic construct
  source 1..23: mol_type = other RNA
tagaagctgaggctcaaagcatt

SEQ ID NO: 2128 - RNA, 23 nt, synthetic construct
  source 1..23: mol_type = other RNA
tagaagctgaggctcaaagcatt

SEQ ID NO: 2129 - RNA, 23 nt, synthetic construct
  source 1..23: mol_type = other RNA
tgagaagctgaggctcaaagcat

SEQ ID NO: 2130 - RNA, 23 nt, synthetic construct
  source 1..23: mol_type = other RNA
tgagaagctgaggctcaaagcat

SEQ ID NO: 2131 - RNA, 23 nt, synthetic construct
  source 1..23: mol_type = other RNA
tctcctgcaggaaggtggagtat

SEQ ID NO: 2132 - RNA, 23 nt, synthetic construct
  source 1..23: mol_type = other RNA
tctcctgcaggaaggtggagtat

SEQ ID NO: 2133 - RNA, 23 nt, synthetic construct
  source 1..23: mol_type = other RNA
tcactttattgagtttctgtgcc

SEQ ID NO: 2134 - RNA, 23 nt, synthetic construct
  source 1..23: mol_type = other RNA
tcactttattgagtttctgtgcc

SEQ ID NO: 2135 - RNA, 23 nt, synthetic construct
  source 1..23: mol_type = other RNA
tgcactttattgagtttctgtgc

SEQ ID NO: 2136 - RNA, 23 nt, synthetic construct
  source 1..23: mol_type = other RNA
tgcactttattgagtttctgtgc

SEQ ID NO: 2137 - RNA, 23 nt, synthetic construct
  source 1..23: mol_type = other RNA
tagcactttattgagtttctgtg

SEQ ID NO: 2138 - RNA, 23 nt, synthetic construct
  source 1..23: mol_type = other RNA
tagcactttattgagtttctgtg

SEQ ID NO: 2139 - RNA, 23 nt, synthetic construct
  source 1..23: mol_type = other RNA
taagcactttattgagtttctgt

SEQ ID NO: 2140 - RNA, 23 nt, synthetic construct
  source 1..23: mol_type = other RNA
taagcactttattgagtttctgt

SEQ ID NO: 2141 - RNA, 23 nt, synthetic construct
  source 1..23: mol_type = other RNA
taaagcactttattgagtttctg

SEQ ID NO: 2142 - RNA, 23 nt, synthetic construct
  source 1..23: mol_type = other RNA
taaagcactttattgagtttctg

SEQ ID NO: 2143 - RNA, 23 nt, synthetic construct
  source 1..23: mol_type = other RNA
tcaaagcactttattgagtttct

SEQ ID NO: 2144 - RNA, 23 nt, synthetic construct
  source 1..23: mol_type = other RNA
tcaaagcactttattgagtttct

SEQ ID NO: 2145 - RNA, 23 nt, synthetic construct
  source 1..23: mol_type = other RNA
tttcaaagcactttattgagttt

SEQ ID NO: 2146 - RNA, 23 nt, synthetic construct
  source 1..23: mol_type = other RNA
tttcaaagcactttattgagttt

SEQ ID NO: 2147 - RNA, 23 nt, synthetic construct
  source 1..23: mol_type = other RNA
tttttcaaagcactttattgagt

SEQ ID NO: 2148 - RNA, 23 nt, synthetic construct
  source 1..23: mol_type = other RNA
tttttcaaagcactttattgagt

SEQ ID NO: 2149 - RNA, 23 nt, synthetic construct
  source 1..23: mol_type = other RNA
ttcaaagcactttattgagtttc

SEQ ID NO: 2150 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggagcccaagaaagtgaaaga

SEQ ID NO: 2151 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggagcccaagaaagtgaaaga

SEQ ID NO: 2152 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagcccaagaaagtgaaagaa

SEQ ID NO: 2153 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagcccaagaaagtgaaagaa

SEQ ID NO: 2154 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcccaagaaagtgaaagacca

SEQ ID NO: 2155 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcccaagaaagtgaaagacca

SEQ ID NO: 2156 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cccaagaaagtgaaagaccaa

SEQ ID NO: 2157 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cccaagaaagtgaaagaccaa

SEQ ID NO: 2158 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaagagaaatgctttgagcca

SEQ ID NO: 2159 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaagagaaatgctttgagcca

SEQ ID NO: 2160 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagagaaatgctttgagccta

SEQ ID NO: 2161 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagagaaatgctttgagccta

SEQ ID NO: 2162 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agagaaatgctttgagcctca

SEQ ID NO: 2163 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agagaaatgctttgagcctca

SEQ ID NO: 2164 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagaaatgctttgagcctcaa

SEQ ID NO: 2165 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagaaatgctttgagcctcaa

SEQ ID NO: 2166 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agaaatgctttgagcctcaga

SEQ ID NO: 2167 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agaaatgctttgagcctcaga

SEQ ID NO: 2168 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaatgctttgagcctcagcta

SEQ ID NO: 2169 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaatgctttgagcctcagcta

SEQ ID NO: 2170 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgctttgagcctcagcttca

SEQ ID NO: 2171 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgctttgagcctcagcttca

SEQ ID NO: 2172 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgctttgagcctcagcttcta

SEQ ID NO: 2173 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgctttgagcctcagcttcta

SEQ ID NO: 2174 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctttgagcctcagcttctca

SEQ ID NO: 2175 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctttgagcctcagcttctca

SEQ ID NO: 2176 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actccaccttcctgcaggaga

SEQ ID NO: 2177 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actccaccttcctgcaggaga

SEQ ID NO: 2178 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacagaaactcaataaagtga

SEQ ID NO: 2179 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacagaaactcaataaagtga

SEQ ID NO: 2180 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acagaaactcaataaagtgca

SEQ ID NO: 2181 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acagaaactcaataaagtgca

SEQ ID NO: 2182 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagaaactcaataaagtgcta

SEQ ID NO: 2183 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagaaactcaataaagtgcta

SEQ ID NO: 2184 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agaaactcaataaagtgctta

SEQ ID NO: 2185 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agaaactcaataaagtgctta

SEQ ID NO: 2186 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaaactcaataaagtgcttta

SEQ ID NO: 2187 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaaactcaataaagtgcttta

SEQ ID NO: 2188 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaactcaataaagtgctttga

SEQ ID NO: 2189 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaactcaataaagtgctttga

SEQ ID NO: 2190 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actcaataaagtgctttgaaa

SEQ ID NO: 2191 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actcaataaagtgctttgaaa

SEQ ID NO: 2192 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcaataaagtgctttgaaaaa

SEQ ID NO: 2193 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcaataaagtgctttgaaaaa

SEQ ID NO: 2194 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aactcaataaagtgctttgaa

SEQ ID NO: 2195 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
tctttcactttcttgggctccaa

SEQ ID NO: 2196 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
tctttcactttcttgggctccaa

SEQ ID NO: 2197 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
ttctttcactttcttgggctcca

SEQ ID NO: 2198 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
ttctttcactttcttgggctcca

SEQ ID NO: 2199 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tggtctttcactttcttgggctc

SEQ ID NO: 2200 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tggtctttcactttcttgggctc

SEQ ID NO: 2201 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
ttggtctttcactttcttgggct

SEQ ID NO: 2202 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
ttggtctttcactttcttgggct

SEQ ID NO: 2203 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
tggctcaaagcatttctctttct

SEQ ID NO: 2204 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
tggctcaaagcatttctctttct

SEQ ID NO: 2205 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
taggctcaaagcatttctctttc

SEQ ID NO: 2206 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
taggctcaaagcatttctctttc

SEQ ID NO: 2207 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
tgaggctcaaagcatttctcttt

SEQ ID NO: 2208 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
tgaggctcaaagcatttctcttt

SEQ ID NO: 2209 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttgaggctcaaagcatttctctt

SEQ ID NO: 2210 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttgaggctcaaagcatttctctt

SEQ ID NO: 2211 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
tctgaggctcaaagcatttctct

SEQ ID NO: 2212 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
tctgaggctcaaagcatttctct

SEQ ID NO: 2213 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
tagctgaggctcaaagcatttct

SEQ ID NO: 2214 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
tagctgaggctcaaagcatttct

SEQ ID NO: 2215 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
tgaagctgaggctcaaagcattt

SEQ ID NO: 2216 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
tgaagctgaggctcaaagcattt

SEQ ID NO: 2217 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
tagaagctgaggctcaaagcatt

SEQ ID NO: 2218 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
tagaagctgaggctcaaagcatt

SEQ ID NO: 2219 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
tgagaagctgaggctcaaagcat

SEQ ID NO: 2220 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
tgagaagctgaggctcaaagcat

SEQ ID NO: 2221 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyluridine
tctcctgcaggaaggtggagtat

SEQ ID NO: 2222 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyluridine
tctcctgcaggaaggtggagtat

SEQ ID NO: 2223 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
tcactttattgagtttctgtgcc

SEQ ID NO: 2224 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
tcactttattgagtttctgtgcc

SEQ ID NO: 2225 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
tgcactttattgagtttctgtgc

SEQ ID NO: 2226 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
tgcactttattgagtttctgtgc

SEQ ID NO: 2227 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
tagcactttattgagtttctgtg

SEQ ID NO: 2228 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
tagcactttattgagtttctgtg

SEQ ID NO: 2229 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
taagcactttattgagtttctgt

SEQ ID NO: 2230 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
taagcactttattgagtttctgt

SEQ ID NO: 2231 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
taaagcactttattgagtttctg

SEQ ID NO: 2232 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
taaagcactttattgagtttctg

SEQ ID NO: 2233 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
tcaaagcactttattgagtttct

SEQ ID NO: 2234 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
tcaaagcactttattgagtttct

SEQ ID NO: 2235 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
tttcaaagcactttattgagttt

SEQ ID NO: 2236 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
tttcaaagcactttattgagttt

SEQ ID NO: 2237 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tttttcaaagcactttattgagt

SEQ ID NO: 2238 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tttttcaaagcactttattgagt

SEQ ID NO: 2239 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttcaaagcactttattgagtttc

SEQ ID NO: 2240 - RNA, 23 nt, synthetic construct
  source 1..23: mol_type = other RNA
ttggagcccaagaaagtgaaaga

SEQ ID NO: 2241 - RNA, 23 nt, synthetic construct
  source 1..23: mol_type = other RNA
ttggagcccaagaaagtgaaaga

SEQ ID NO: 2242 - RNA, 23 nt, synthetic construct
  source 1..23: mol_type = other RNA
tggagcccaagaaagtgaaagac

SEQ ID NO: 2243 - RNA, 23 nt, synthetic construct
  source 1..23: mol_type = other RNA
tggagcccaagaaagtgaaagac

SEQ ID NO: 2244 - RNA, 23 nt, synthetic construct
  source 1..23: mol_type = other RNA
gagcccaagaaagtgaaagacca

SEQ ID NO: 2245 - RNA, 23 nt, synthetic construct
  source 1..23: mol_type = other RNA
gagcccaagaaagtgaaagacca

SEQ ID NO: 2246 - RNA, 23 nt, synthetic construct
  source 1..23: mol_type = other RNA
agcccaagaaagtgaaagaccat

SEQ ID NO: 2247 - RNA, 23 nt, synthetic construct
  source 1..23: mol_type = other RNA
agcccaagaaagtgaaagaccat

SEQ ID NO: 2248 - RNA, 23 nt, synthetic construct
  source 1..23: mol_type = other RNA
agaaagagaaatgctttgagcct

SEQ ID NO: 2249 - RNA, 23 nt, synthetic construct
  source 1..23: mol_type = other RNA
agaaagagaaatgctttgagcct

SEQ ID NO: 2250 - RNA, 23 nt, synthetic construct
  source 1..23: mol_type = other RNA
gaaagagaaatgctttgagcctc

SEQ ID NO: 2251 - RNA, 23 nt, synthetic construct
  source 1..23: mol_type = other RNA
gaaagagaaatgctttgagcctc

SEQ ID NO: 2252 - RNA, 23 nt, synthetic construct
  source 1..23: mol_type = other RNA
aaagagaaatgctttgagcctca

SEQ ID NO: 2253 - RNA, 23 nt, synthetic construct
  source 1..23: mol_type = other RNA
aaagagaaatgctttgagcctca

SEQ ID NO: 2254 - RNA, 23 nt, synthetic construct
  source 1..23: mol_type = other RNA
aagagaaatgctttgagcctcag

SEQ ID NO: 2255 - RNA, 23 nt, synthetic construct
  source 1..23: mol_type = other RNA
aagagaaatgctttgagcctcag

SEQ ID NO: 2256 - RNA, 23 nt, synthetic construct
  source 1..23: mol_type = other RNA
agagaaatgctttgagcctcagc

SEQ ID NO: 2257 - RNA, 23 nt, synthetic construct
  source 1..23: mol_type = other RNA
agagaaatgctttgagcctcagc

SEQ ID NO: 2258 - RNA, 23 nt, synthetic construct
  source 1..23: mol_type = other RNA
agaaatgctttgagcctcagctt

SEQ ID NO: 2259 - RNA, 23 nt, synthetic construct
  source 1..23: mol_type = other RNA
agaaatgctttgagcctcagctt

SEQ ID NO: 2260 - RNA, 23 nt, synthetic construct
  source 1..23: mol_type = other RNA
aaatgctttgagcctcagcttct

SEQ ID NO: 2261 - RNA, 23 nt, synthetic construct
  source 1..23: mol_type = other RNA
aaatgctttgagcctcagcttct

SEQ ID NO: 2262 - RNA, 23 nt, synthetic construct
  source 1..23: mol_type = other RNA
aatgctttgagcctcagcttctc

SEQ ID NO: 2263 - RNA, 23 nt, synthetic construct
  source 1..23: mol_type = other RNA
aatgctttgagcctcagcttctc

SEQ ID NO: 2264 - RNA, 23 nt, synthetic construct
  source 1..23: mol_type = other RNA
atgctttgagcctcagcttctca

SEQ ID NO: 2265 - RNA, 23 nt, synthetic construct
  source 1..23: mol_type = other RNA
atgctttgagcctcagcttctca

SEQ ID NO: 2266 - RNA, 23 nt, synthetic construct
  source 1..23: mol_type = other RNA
atactccaccttcctgcaggagg

SEQ ID NO: 2267 - RNA, 23 nt, synthetic construct
  source 1..23: mol_type = other RNA
atactccaccttcctgcaggagg

SEQ ID NO: 2268 - RNA, 23 nt, synthetic construct
  source 1..23: mol_type = other RNA
ggcacagaaactcaataaagtgc

SEQ ID NO: 2269 - RNA, 23 nt, synthetic construct
  source 1..23: mol_type = other RNA
ggcacagaaactcaataaagtgc

SEQ ID NO: 2270 - RNA, 23 nt, synthetic construct
  source 1..23: mol_type = other RNA
gcacagaaactcaataaagtgct

SEQ ID NO: 2271 - RNA, 23 nt, synthetic construct
  source 1..23: mol_type = other RNA
gcacagaaactcaataaagtgct

SEQ ID NO: 2272 - RNA, 23 nt, synthetic construct
  source 1..23: mol_type = other RNA
cacagaaactcaataaagtgctt

SEQ ID NO: 2273 - RNA, 23 nt, synthetic construct
  source 1..23: mol_type = other RNA
cacagaaactcaataaagtgctt

SEQ ID NO: 2274 - RNA, 23 nt, synthetic construct
  source 1..23: mol_type = other RNA
acagaaactcaataaagtgcttt

SEQ ID NO: 2275 - RNA, 23 nt, synthetic construct
  source 1..23: mol_type = other RNA
acagaaactcaataaagtgcttt

SEQ ID NO: 2276 - RNA, 23 nt, synthetic construct
  source 1..23: mol_type = other RNA
cagaaactcaataaagtgctttg

SEQ ID NO: 2277 - RNA, 23 nt, synthetic construct
  source 1..23: mol_type = other RNA
cagaaactcaataaagtgctttg

SEQ ID NO: 2278 - RNA, 23 nt, synthetic construct
  source 1..23: mol_type = other RNA
agaaactcaataaagtgctttga

SEQ ID NO: 2279 - RNA, 23 nt, synthetic construct
  source 1..23: mol_type = other RNA
agaaactcaataaagtgctttga

SEQ ID NO: 2280 - RNA, 23 nt, synthetic construct
  source 1..23: mol_type = other RNA
aaactcaataaagtgctttgaaa

SEQ ID NO: 2281 - RNA, 23 nt, synthetic construct
  source 1..23: mol_type = other RNA
aaactcaataaagtgctttgaaa

SEQ ID NO: 2282 - RNA, 23 nt, synthetic construct
  source 1..23: mol_type = other RNA
actcaataaagtgctttgaaaac

SEQ ID NO: 2283 - RNA, 23 nt, synthetic construct
  source 1..23: mol_type = other RNA
actcaataaagtgctttgaaaac

SEQ ID NO: 2284 - RNA, 23 nt, synthetic construct
  source 1..23: mol_type = other RNA
  modified_base 1: mod_base = OTHER; note = 2'-O-methylguanosine-3'-phosphate
  modified_base 2: mod_base = OTHER; note = 2'-O-methyladenosine-3'-phosphate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphate
  modified_base 22: mod_base = OTHER; note = 2'-O-methyladenosine-3'-phosphate
  modified_base 23: mod_base = OTHER; note = 2'-O-methyladenosine
gaaactcaataaagtgctttgaa

SEQ ID NO: 2285 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluorocytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluorouridine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatccaaaatattctacaaaa

SEQ ID NO: 2286 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methyladenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-deoxy-2'-fluoroguanosine-3'-phosphate
  modified_base 19: mod_base = OTHER; note = 2'-O-methyladenosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttttgtagaatattttggatttc

SEQ ID NO: 2287 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatccaaaatattctacaaaa

SEQ ID NO: 2288 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttttgtagaatattttggatttc

SEQ ID NO: 2289 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatccaaaatattctacaaaa

SEQ ID NO: 2290 - RNA, 23 nt, synthetic construct
  source 1..23: mol_type = other RNA
  modified_base 1: mod_base = OTHER; note = 2'-deoxy-2'-fluorouridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttttgtagaatattttggatttc

SEQ ID NO: 2291 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accaaagtcgctgagtacata

SEQ ID NO: 2292 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tatgtactcagcgactttggtgt

SEQ ID NO: 2293 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accaaagtcgctgagtacata

SEQ ID NO: 2294 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tatgtactcagcgactttggtgt

SEQ ID NO: 2295 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accaaagtcgctgagtacata

SEQ ID NO: 2296 - RNA, 23 nt, synthetic construct
  source 1..23: mol_type = other RNA
  modified_base 1: mod_base = OTHER; note = 2'-deoxy-2'-fluorouridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tatgtactcagcgactttggtgt

SEQ ID NO: 2297 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluorouridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylguanosine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluorocytidine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtggtcatcaaataagtgctt

SEQ ID NO: 2298 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aagcacttatttgatgaccacat

SEQ ID NO: 2299 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtggtcatcaaataagtgctt

SEQ ID NO: 2300 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aagcacttatttgatgaccacat

SEQ ID NO: 2301 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtggtcatcaaataagtgctt

SEQ ID NO: 2302 - RNA, 23 nt, synthetic construct
  source 1..23: mol_type = other RNA
  modified_base 1: mod_base = OTHER; note = 2'-deoxy-2'-fluoroadenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aagcacttatttgatgaccacat

SEQ ID NO: 2303 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyluridine-3'-phosphate
  modified_base 5: mod_base = OTHER; note = 2'-deoxy-2'-fluorocytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluorocytidine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aactcaataaagtgctttgaa

SEQ ID NO: 2304 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-deoxy-2'-fluoroadenosine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttcaaagcactttattgagtttc

SEQ ID NO: 2305 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aactcaataaagtgctttgaa

SEQ ID NO: 2306 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttcaaagcactttattgagtttc

SEQ ID NO: 2307 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aactcaataaagtgctttgaa

SEQ ID NO: 2308 - RNA, 23 nt, synthetic construct
  source 1..23: mol_type = other RNA
  modified_base 1: mod_base = OTHER; note = 2'-deoxy-2'-fluorouridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttcaaagcactttattgagtttc

SEQ ID NO: 2309 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorocytidine-3'-phosphate
  modified_base 4: mod_base = OTHER; note = 2'-O-methylcytidine-3'-phosphate
  modified_base 5: mod_base = OTHER; note = 2'-deoxy-2'-fluorocytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methylcytidine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agcccaagaaagtgaaagaca

SEQ ID NO: 2310 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-deoxy-2'-fluoroguanosine-3'-phosphate
  modified_base 19: mod_base = OTHER; note = 2'-O-methylguanosine-3'-phosphate
  modified_base 20: mod_base = OTHER; note = 2'-deoxy-2'-fluorocytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
tgtctttcactttcttgggctcc

SEQ ID NO: 2311 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aataaagtgctttgaaaacgt

SEQ ID NO: 2312 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
acgttttcaaagcactttattga

SEQ ID NO: 2313 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aataaagtgctttgaaaacgt

SEQ ID NO: 2314 - RNA, 23 nt, synthetic construct
  source 1..23: mol_type = other RNA
  modified_base 1: mod_base = OTHER; note = 2'-deoxy-2'-fluoroadenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
acgttttcaaagcactttattga

SEQ ID NO: 2315 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagaaagagaagtgctttgaa

SEQ ID NO: 2316 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttcaaagcacttctctttctggc

SEQ ID NO: 2317 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagaaagagaagtgctttgaa

SEQ ID NO: 2318 - RNA, 23 nt, synthetic construct
  source 1..23: mol_type = other RNA
  modified_base 1: mod_base = OTHER; note = 2'-deoxy-2'-fluorouridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttcaaagcacttctctttctggc

SEQ ID NO: 2319 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagaaagagaagtgctttgaa

SEQ ID NO: 2320 - RNA, 23 nt, synthetic construct
  source 1..23: mol_type = other RNA
  modified_base 1: mod_base = OTHER; note = 2'-deoxy-2'-fluorouridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttcaaagcacttctctttctggc

SEQ ID NO: 2321 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluorocytidine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaggaaattgactgcaatgaa

SEQ ID NO: 2322 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
ttcattgcagtcaatttcctcgg

SEQ ID NO: 2323 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaggaaattgactgcaatgaa

SEQ ID NO: 2324 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
ttcattgcagtcaatttcctcgg

SEQ ID NO: 2325 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaggaaattgactgcaatgaa

SEQ ID NO: 2326 - RNA, 23 nt, synthetic construct
  source 1..23: mol_type = other RNA
  modified_base 1: mod_base = OTHER; note = 2'-deoxy-2'-fluorouridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
ttcattgcagtcaatttcctcgg

SEQ ID NO: 2327 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methylcytidine-3'-phosphate
  modified_base 5: mod_base = OTHER; note = 2'-deoxy-2'-fluorouridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluorouridine-3'-phosphate
  modified_base 14: mod_base = OTHER; note = 2'-O-methylguanosine-3'-phosphate
  modified_base 15: mod_base = OTHER; note = 2'-deoxy-2'-fluorouridine-3'-phosphate
  modified_base 16: mod_base = OTHER; note = 2'-O-methylguanosine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacctactcaattgtgcaaaa

SEQ ID NO: 2328 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyladenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-deoxy-2'-fluoroguanosine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
ttttgcacaattgagtaggtaat

SEQ ID NO: 2329 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacctactcaattgtgcaaaa

SEQ ID NO: 2330 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
ttttgcacaattgagtaggtaat

SEQ ID NO: 2331 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacctactcaattgtgcaaaa

SEQ ID NO: 2332 - RNA, 23 nt, synthetic construct
  source 1..23: mol_type = other RNA
  modified_base 1: mod_base = OTHER; note = 2'-deoxy-2'-fluorouridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
ttttgcacaattgagtaggtaat

SEQ ID NO: 2333 - RNA, 21 nt, synthetic construct
  source 1..21: mol_type = other RNA
aataaagtgctttgaaaacga

SEQ ID NO: 2334 - RNA, 21 nt, synthetic construct
  source 1..21: mol_type = other RNA
aataaagtgctttgaaaacga

SEQ ID NO: 2335 - RNA, 23 nt, synthetic construct
  source 1..23: mol_type = other RNA
tcgttttcaaagcactttattga

SEQ ID NO: 2336 - RNA, 23 nt, synthetic construct
  source 1..23: mol_type = other RNA
tcgttttcaaagcactttattga

SEQ ID NO: 2337 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aataaagtgctttgaaaacga

SEQ ID NO: 2338 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aataaagtgctttgaaaacga

SEQ ID NO: 2339 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
tcgttttcaaagcactttattga

SEQ ID NO: 2340 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
tcgttttcaaagcactttattga

SEQ ID NO: 2341 - RNA, 23 nt, synthetic construct
  source 1..23: mol_type = other RNA
  modified_base 1: mod_base = OTHER; note = 2'-O-methyluridine-3'-phosphate
  modified_base 2: mod_base = OTHER; note = 2'-O-methylcytidine-3'-phosphate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphate
  modified_base 22: mod_base = OTHER; note = 2'-O-methylguanosine-3'-phosphate
  modified_base 23: mod_base = OTHER; note = 2'-O-methyladenosine
tcaataaagtgctttgaaaacga

SEQ ID NO: 2342 - RNA, 23 nt, synthetic construct
  source 1..23: mol_type = other RNA
  modified_base 1: mod_base = OTHER; note = 2'-O-methyluridine-3'-phosphate
  modified_base 2: mod_base = OTHER; note = 2'-O-methylcytidine-3'-phosphate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphate
  modified_base 22: mod_base = OTHER; note = 2'-O-methylguanosine-3'-phosphate
  modified_base 23: mod_base = OTHER; note = 2'-O-methyladenosine
tcaataaagtgctttgaaaacga

SEQ ID NO: 2343 - DNA, 21 bp, synthetic construct
  source 1..21: mol_type = other DNA
  modified_base 1: mod_base = OTHER; note = 2'-O-methylcytidine-3'-phosphate
  modified_base 2: mod_base = OTHER; note = 2'-O-methyluridine-3'-phosphate
  modified_base 3: mod_base = OTHER; note = 2'-O-methyluridine-3'-phosphate
  modified_base 4: mod_base = OTHER; note = adenosine-3'-phosphate
  modified_base 5: mod_base = OTHER; note = 2'-O-methylcytidine-3'-phosphate
  modified_base 6: mod_base = OTHER; note = guanosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = 2'-O-methyluridine-3'-phosphate
  modified_base 13: mod_base = OTHER; note = adenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = guanosine-3'-phosphate
  modified_base 19: mod_base = OTHER; note = adenosine-3'-phosphate
  modified_base 20: mod_base = OTHER; note = 2'-deoxythymidine-3'-phosphorothioate
  misc_feature 1..19: note = RNA
  misc_feature 20..21: note = DNA
cttacgctgagtacttcgatt

SEQ ID NO: 2344 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = 2'-O-methyluridine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = 2'-O-methylcytidine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = 2'-O-methyluridine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = guanosine-3'-phosphate
  modified_base 20: mod_base = OTHER; note = 2'-deoxythymidine-3'-phosphorothioate
  misc_feature 1..19: note = RNA
  misc_feature 20..21: note = DNA
tcgaagtactcagcgtaagtt

We claim:

1. A double stranded ribonucleic acid (dsRNA) agent for inhibiting expression of Factor XII (Hageman Factor) (F12), or a salt thereof,
   wherein the dsRNA agent, or a salt thereof, comprises a sense strand and an antisense strand forming a double stranded region,
   wherein the sense strand comprises at least 19 contiguous nucleotides from nucleotides 433-460 of the nucleotide sequence of SEQ ID NO:9 and the antisense strand comprises at least 19 contiguous nucleotides from the corresponding nucleotides of the nucleotide sequence of SEQ ID NO:10,
   wherein all of the nucleotides of the sense strand and all of the nucleotides of the antisense strand comprise a nucleotide modification, and
   wherein the sense strand is conjugated to a ligand attached at the 3'-terminus.

2. The dsRNA agent, or a salt thereof, of claim 1, wherein the at least one nucleotide modifications is selected from the group consisting of a deoxy-nucleotide modification, a 3'-terminal deoxy-thymine (dT) nucleotide modification, a 2'-O-methyl nucleotide modification, a 2'-fluoro nucleotide modification, a 2'-deoxy-nucleotide modification, a locked nucleotide modification, an unlocked nucleotide modification, a conformationally restricted nucleotide modification, a constrained ethyl nucleotide modification, an abasic nucleotide modification, a 2'-amino-nucleotide modification, a 2'-O-allyl-nucleotide modification, 2'-C-alkyl-nucleotide modification, 2'-hydroxly-nucleotide modification, a 2'-methoxyethyl nucleotide modification, a 2'-O-alkyl-nucleotide modification, a morpholino nucleotide modification, a phosphoramidate modification, a non-natural base comprising nucleotide modification, a tetrahydropyran nucleotide, a 1,5-anhydrohexitol nucleotide modification, a cyclohexenyl nucleotide modification, a nucleotide comprising a phosphorothioate group modification, a nucleotide comprising a methylphosphonate group modification, a nucleotide comprising a 5'-phosphate modification, and a nucleotide comprising a 5'-phosphate mimic modification.

3. The dsRNA agent, or a salt thereof, of claim 1, further comprising at least one phosphorothioate internucleotide linkage.

4. The dsRNA agent, or a salt thereof, of claim 1, wherein each strand is independently 19-25 nucleotides in length.

5. The dsRNA agent, or a salt thereof, of claim 1, wherein at least one strand comprises a 3' overhang of at least 1 nucleotide; or a 3' overhang of at least 2 nucleotides.

6. The dsRNA agent, or a salt thereof, of claim 1, wherein the ligand is an N-acetylgalactosamine (GalNAc) derivative.

7. The dsRNA agent, or a salt thereof, of claim 6, wherein the ligand is

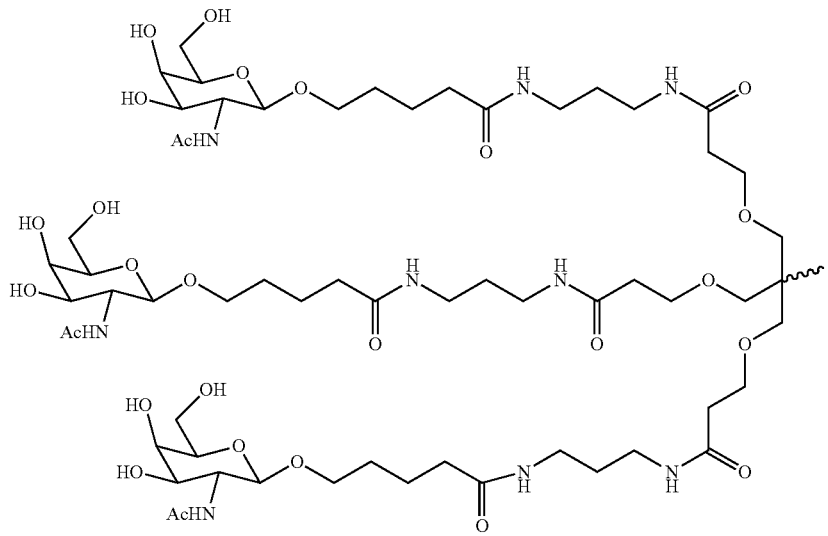 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

8. The dsRNA agent, or a salt thereof, of claim 7, wherein the dsRNA agent, or a salt thereof, is conjugated to the ligand as shown in the following schematic

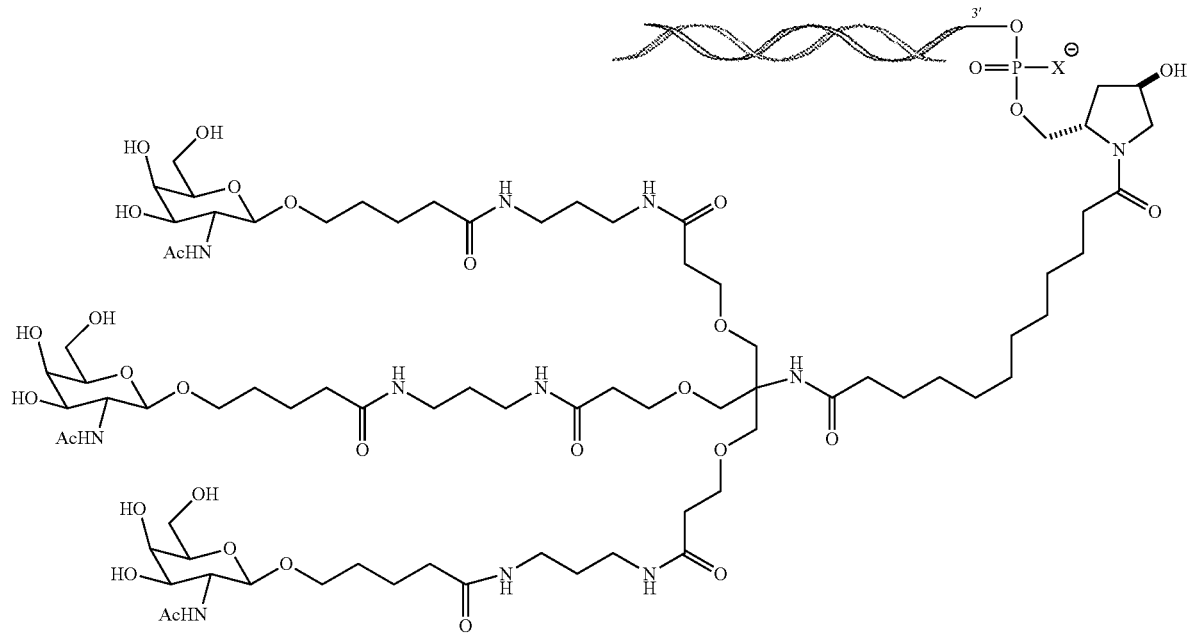

and, wherein X is O or S.

9. The dsRNA agent, or a salt thereof, of claim 1, wherein the sense strand and the antisense strand comprise nucleotide sequences selected from the group consisting of:

```
                                  (SEQ ID NO: 402)
(a) 5'-CUGCCAGAAAGAGAAGUGCUU-3'
and (SEQ ID NO: 452)
5'-AAGCACUUCUCUUUCUGGCAGUG-3';
and (SEQ ID NO: 403)
(b) 5'-CAGAAAGAGAAGUGCUUUGAA-3'
and (SEQ ID NO: 453)
5'-UUCAAAGCACUUCUCUUUCUGGC-3'.
```

10. The dsRNA agent, or a salt thereof, of claim 1, further comprising 6-8 phosphorothioate internucleotide linkages.

11. A cell containing the dsRNA agent, or a salt thereof, of claim 1.

12. A pharmaceutical composition comprising the dsRNA agent, or a salt thereof, of claim 1.

13. A method of inhibiting expression of a contact activation pathway gene in a cell, the method comprising:
   (a) contacting the cell with the dsRNA agent, or a salt thereof, of claim 1; and
   (b) maintaining the cell produced in step (a) for a time sufficient to obtain degradation of the mRNA transcript of the contact activation pathway gene, thereby inhibiting expression of the contact activation pathway gene in the cell.

14. A method of treating a subject having a disease or disorder that would benefit from reduction in expression of a contact activation pathway gene, the method comprising administering to the subject a therapeutically effective amount of the dsRNA agent, or a salt thereof, of claim 1, thereby treating said subject.

15. The method of claim 14, wherein the disorder is a contact activation pathway-associated disease.

16. The method of claim 14, wherein the subject is human.

* * * * *